United States Patent 10,724,096 (METHODS AND COMPOSITIONS FOR INHIBITING AND TREATING NEUROLOGICAL CONDITIONS) - sequence listing, part 81

SEQ ID NO: 1620 - DNA, 238510 bp, Homo sapiens
acctgagactacctttctgcgatcacaggattcccggcggtgacttgaccccggaagtggggtgtgaagctccggtgctggtgcggcgggggactgcggggccagcctcaggtacctcgtctcgcgggaggcgccgcaaccttactgtttccccattcttcccgcgaacagagtcaaaagagctaggcgggagtcggcactagctgctgccgcggtgctgtgggtgctgcgtaccagctgttcactgctgtctcgccttccctcttgccagttctgcgtgggaggcgcgggagttttgcggaatgatacgtggtgtggcgtcggggttgtgatacccgcccccttggagatgggcagcggggtcatcagtgatcttgatcactttcttcaggcttttgccacttgttggctgagggtcgatttactcccttagctgcgtcactctactttctccactttctccacctgtaagaagagagattgatccgattacttctaagacgttttttagcccaacctggccacactgcggaggcgccggttctttcaccccgctaacccctccgtgttggcagccaatagaagcacttaaggatgggtaacggggaagaaccactggccagtactaggggagacaagcttaaatcgttgttagaccccgagctagggttccccgagctagggttctcccttctgaggcgtgttttccccatctgcaaaacgaagggttaggcggaatgatttgcaaggtcccagttgactctgacttttggccatatgtttgactcaacagtttaaaccccctcagcagtctttctgtcgttgccctccacactgcgagactctggagggcgatctggaggtctggaagataaccgattcctgggagatttgggggtagtctccaatctgtccctggctcatcttgtgacccgaagccggcggccttgccaggagtattctagaatgagtgcacataaaaataccttcaaacggtacggtggaaattggacagaagttttaattgggtattataacgttgtggaaactgagtctgtgaattggcccaaagctacagaattgtcatcgttcaaattcccttaagcaaaaaagatccgatttgagacttcacgtggcaatttaagattggaatctcatgtacgataattaaatgatagtctcccttagtgtttccttagcacttaataggtttgtcttagttttactcactaacggtactttaaaggatttcattaaacagatgtagaatgtgtgtcagtggtgtataaaaaagttgtggttgtattggtgcaagtcagtaaagtctattttatattacagctttaagtcttttgtactttagcattgttttgcaaagcaagttgatgtgcattatataggggagagtacacacatcaatgtctttaatagcatttttttttgaggcaagatctctctctgtcacccagactggagtgcagtagcatgcacatagctcactgcagcctttaactcgtaggcttaagcgatcctctcacctcagcctgccaagtagctgggactataagcacataccaccacacccagctaataaagattttttttttgttgtttgtttttttttgttcagatggggcctcgccatgttgaccaggcttatctcaaactcctgggctcaggcgatccctccctcccccgtctccctcccaaagtactggaattacaggtgtgagccttggtgcgtaccctgtaatagtgattttttttttttttaaagagcactcctgtgagtaccagatgttaatgtcgttgtttacctgcagttagaaagaccacttttaagcaaaggctttcttttaaaacagggagatgagcaggaagataatttaaaacagctttttcgtgtatttttgagtcacttaaaatattataaaatacatgatgtacagaaaaaagtatagctagccgatttgcatagttttgagagaaatgaaatgaatccatggggcctgtcattcagctgaagaaatggaactttaccagttaccagtaaattttaccagtttgcacttccccaatgaagccctccttgctacagccataagtaaacactatcttgaaatttgtgttaagcttcctaagcttttctaggtggttttatcacacatgcaggcgttgctaaatggtatgttgtttaatattgccagtctttgacctttatataaacagaaacgtatgtatcttctgacttcttttgtttgtttttgagattcatctatgttgacgaatgtacgtagatcatatttttttttctgttacaggtaggcatgagtgggacagtagtgggctctcccccaacccactagaaatgttgggggatggtttggcaattaccgaatttgcttctctaaaaatgataattctgcagcgccagggagaggccatttcctgatggtccacacctgttatcaaaatgttaattgaatgtagacccgagggagaaacagcttcctgggcatgcatattaagagacaaaaatggtaaagtatgatcttccaggtacactccaccggaaaaaggaaggaagcctcagatgggcgtgcatgtaactccctaaaaacacttcccaaggctaaggagggctctgtgcctgccggcagcctatcctaaggaaagaatcatgggaaatagacaagcttgtaaaagtcctaggatcagggccgggcgcggtggctcacgcctgtaatcccagcactttgggaggctgaagcgggtggatcacctcagatcagaagttcaagaccaccctggtcaacatggtgaaaccctgtctctactaaatatacaaaaaagtatccaggcgcgatggcgggggcctgtagtcccagctactcgggaggctgaggcaggagaatggcgtgaacccgagaggcggagcttgcagtgagccgagatcgcgccacttcactccaacctgggccacagagcgagactccctctcaaaaaaaaaaaaaacaaacaaacgaaaaaaaaaggatcaacggttaaatcggacacttgacctactctctttaaccttcacattcccgcttgggtctctaacaagcacaccttcctttcttcctgttttaaggccttttaaagtaaacttccattcctgctctggaacttgcctgggtctctgtttctgctttatgcccctcagtcaaattttttcgtctgaggaggcaaggactgaagttgctactgacccgtgaggataggccaccggtaacttggggtaacttggatctctgccactagtaaaaaaatgatttccccaaatggtggtaccagtttactctcttacctggagtataagacagtttacagttattgtatattcttggcaactcttggagttttttcccccaatttgatggatatgaagtgtttttttgtcgtgaccctaatttgcactccctgattactgaaaagtttgaacattttttcagatttttattggttatttatgtttatctttttttccttgatttttctttttcttactgacttttaagagctttttattagtgagatattgtaatggtacaagtgttgtctgtttttggcctatctttccgtttccttccttcattccatcctttttttttttttattaggaagacctcttttaatatagttaaacattttcccccttaagtttaatgtaggagaaaagtccattaaaatctcatttatgaattctttgatacatcgtactcttaaaggtattctatttttcctaaaatgtttagagttttgcctttcatatttaatagtccgtcatctagaattcactcttcatgtatgttgtcagataagtctccaatctctgttttgttttaatttcagttgtcctaatgtgatttgactgtatcacctttttgccaccttcacttgtcaccttaagtttacagatatgtgtggagtcaattctattctatggatctatttttctatccctgaaccactacctattttctttaatagtgtagcttatcataacttttgatgtctggggctgtgttctcgggaatgtcttggttatttttgtctctttgctcttctgtatagaatgtagcttatgaatttccaggaaaaactgtgttggaattttgatcaaaattgcactgtatccttggatgtatttcaggaaaagtaacacctgaatgtcaactcttactatccttgagccattttggtcctcttaaaatctttccaaaaggtctcatacttttctacataaaagttttgacttttagcttagatttattcctagataccttgtttttgttgctattatgaatggtatcattttttaaattaaagattttaactgattgttttggtatatagaaatgccattttaagaattttctatcagttttttttggaattttctattcatatttgaataattatagttttgtttcttaagaattcttacatattttatttatctttcttaccttttgcctaggatagagccttcagtaccattttgaatagaaatagtgtttaagtcaagatggggtttagctgcataaacaaaagtatctttaatgcacaaacgcttattctcacatgtgaaagaagtccacagctgtgcaacttagtacttatgtggtagtgcactaagactcagggccccaggttctttctgtctttctgtagttctacattcaatatctagttccatatttatggttatctcataggccaggtaagtgatggagcttcagctatcaagtaaatccacgttctatgtggcagagaagtggacccgcattcagcttcctttaaggagtattccccgaagtccttcccaacttgaatttctgtttattagattaaggaattttccttctattcctagtttgataagcattttaattgaattgttacggaatttgatcaaatgcattttttgccttaattgagatgattgaaatgagtatgtatttttcagtgtttgaaccaagctcacattcttggaagcttggttatgatatattgtcttttatatatattcctggatttgatttgctgttgtttttgtttaggatttttttttttttaatctatgttcatgagtgagattggtctgtaattttccttttttgtatagtccttgtcaaaatttggcattatggttataagacaggagaattccctggacccctttgtgggacttggaaccagggtgtggctcgtttgctcggctgccgtgtactcaaaccccttacgggagagggagcatgcaggtgagcaggtgcaggagttggggtgagtgatttgggcctccagccccatggcagtgtctaggggcgttacagtgctcttttagccctgccgtctgggaatggcttaagtgttaaatagctcagtagagtcagtgtgacagcctttttgggttcccacacccagtgcatcctgaattcttgtctagcatcgaggaggaatcaggttacatgggcttgaaagatggtgaatgtgggcattttattgagtgatggaggtggctctcagtgggatggtgatacggtttggctgtgccccactcaaatctcatcttgaattgtagctcccataattcccatgtgttgtgggagggacccgatgagagataactgaatcatggggacagtttcccccatactgttctcgtggtagtgaataagtctcacgagatctgatggctttataaggggaaacccctttcgctggatttttttttttttttttttttttttaattctctcgtctgacaccatgtaagacgtaccttttgctttccgccatgattgtgaggtctccccagccacgtggaactgtgagtccattaaacccctttttctttataaattacccagtctcaggggtgtctttatcagcagtatgaaaatgaactaatacagatggggagctggagaggggatggagtgggaagatgatcttcccttggagttcggctgtcccatggccaatctcctctctgaccgtccccagccaaactcccctcgacactcagatgcttcctctcttctctcctctgctgcaccattctgctgctctgccactcttctgctcatggagcctggggtttggggtttatatgggcacagaataggggtgacatattgggccaaaaggcaacatttgggtgcaaaaacagcctgttcacatttagggctatgggtccaggcttaagggtggagccctcgccagggaccccacccttctgccgcttgtccgtatcagttacactagttttgtgaaattagtgtggagtgtttcttttatttattctccaagattgtacataaaactgaaattatctattgagtgtttggtagtgttcacctataaaaccttttagatcactatagttatctttgactagagctttagacatttcccacaagtttttataagcaggtgtacattaagttctaggtattttctagttttcagcatatttcttttttgacccatgcattatttttgtttcaaaatgtataggttttattaaagttattttgataattcccagtgaaactgcattataatctgagggtatggtttgtctaattctttgcaattatatgagactaattctttgaaattatgtgaggcttgctttaaggcttattaggaacatggacaatttttcatgtgtgcttggcaaaaaaatgtattttccagttgttggatccagtgtgtaaattgcactgttcacataattctgttttctttttgtctgcttaatatctcaattatcgataaatatgtgacatagcctatagatggtagcattgtcaaatttctccttgaagccctgatgacttttgctatatatatacatttctttaagagacagggtcttcctctgttgctgaggctggactgcagtggcgtgattgtggtgcaatgcagccttgaactcctgagctcaaggctcagctttctgagtagctgggactgcaggcacgtgccatcacacccagctaatttaaaataaaatctttcttttgtagagacgggttctttctttgttgcccaggctggtccataactgctaggctcaagcaagcctccctccttggcctctcagagtgctaggattacaggtgtgagtcactgtgcctggcttggctttaaagtttttgttgttgttgtttgctactattatagacgtgccagctgtgttttggttagaatttatttgtcttatcgttttccatcctatatctcacctaggggagacaagacccatgggcttgaatgctcattttctcatttcttttgtagcttagctgacagctggcctgggaggtctcagctgaaggtaaaaacaggctgataccagccagtgggctccagtggcctccttcttcttaaagaagtcatttcgttctaaatcaggagatttccattaggacttaattgcctagatgtatgggggatggattcctttctaagagagcactagcgtttgacagatcatgagtgatttgctgtttctctgcttaagttttctccgcttaagttttctccagtaaaccatagactttatactgtgtggcccttctgttatttgtgtttgtgttggcctgacagctttaactttttttgtattcttatgttccaggtgtgtctgtcttgtaaatagtgcatatagctggcgattcattttttctctcttttgtccatttatattgattgtggctactgatgtattatgatttgtcttagtctatgtagtgttgctattacagaataccacagactgggtaatttataaagaaaataaaattggcaggggaattggctcactcctgtaatcccagcactttgggaggccgaggcaggtagatcccttgaattcaggagttcgagacaagcctgggcaacatggtgaaagcccatctctacaaaaaatacaaaaattagctggccatggtggtgtgtgtgcctgtggtcctagctacttgggaggctgaggtgggaggatggcttgagttcaggaggtggaggttgcagtgagctaagatcgtgtcactgtgttccagcctgggcgacagagtgagaccctgtctcaaaaaagaaagaaagaaaaaaaaaggccgggcgcggtcgctcacacttgtaatcccagcactttgggaggccgaggtgggtggatcacctgaggtcaggagttgagaccagcctggccaacatggcaaaaccctgtctctactaaaagtacaaaaattagccaggcatggtggcggatgcctgtaatcccagctactcaggaggctgaggcaggagaatcgcttgaacccaggaagtggagattgcagtaagccaagattgtgccactgcactccagcccgtgcgacaagagcgagactccatctcaaaaaaaaaaaaaaaaaaaaagaaaagaaaagaataaaaaaggaaaggaaatgatgtcttatagttctagaggcttggatgtccaaggtccagggacccacatctggcaggggcttgttatgaggaagacagaaaggcaagagaccatgagagaaatgtaagggaaggggactaactaatgctttttttcaggaaactactcccccaataacttaacccactctagcaataatggcattaatccatttatgaggtcagagctctcataacctggttaccttttataggtcccagctctcaacactgttgcattggcaattaagtttctaacacatgaactttggggaacatattcaaaccacagcaggattaatttccacgtcagttttttgcttcctatgtgttctgttttgttgttattttttcctttcttgccttcttttgcattgatttttttgttacttttttcttctttaatgttatcagtctgtgttaatttgaatgttatacattctgtattcttgttggtgggggggcccaccctacaaattttaacctgctgccatggtccgaatgtttgtctctctccccccacccaattcatatgctgaaatcctaacccctaaggtgatggcatatagtattaggaggtaaggcctttgagagggcacatgaattggattcatgcccttataaaagagtcagagagatcccttgctccttcaaccatatgaaattatagtgaaaagatggctgtctgtgaaccagaaagtgggcattcatcagacactgaatatactggagctttgatcttacactttccagcctctaggactgtgagaagtaaatttctgtttataagttacctaattcatggtattttgttatagcagcatggacagattaagaagcatgcatattaatcttgaagtcgaaagttactttgggtcaagacagaacctgtaattccatttaccttttcccaatttttatgctgttgtctagagatttagttctgttttgatttcttgtaatcccacaatttacgttcttgtaactctgcctagacattattattgctttatgcagttaatatttgcttgaaattacccatatatttatcattttctttacttaatatttttacagcttcatcagttcatgtttgtttttctgagtgtttatttcattcgagttctcaaagcatagttttattatctttctgtggtatagaattctaagtggatggttaatttcttccaaaactaatgtaatgataatattttactcttgtaatgtctgctttgttttaaattgtgattttgctgtaggcttacatgtctcattatttgcttgatcctcagttgtaacaggatggtagtgatggctgcaggacagtgtgaatgtacctaatgccactaaaccgtacacttaaaaattgtttaaatgataaattttatgtagtatgtttattaccacagttaataagtaaaacaaagtttaagctggttaaagtggcaatgttacttgtgccaaacgcaccttgatttactaatccagccattctgcatcctgaacccagaatggtccacctaaaatatcagactgatcactctccatccagtgatttcctccggcatcactgttaagtccaaactccttggcatggcatataagaaagacattccaggttctggccatggcttacctttacctttaatgctgtccctccccaacactttattataaccttcactgagatcttggttaatgtatagtcagatttgttgtactcaggaaccagcagaatccccatatttgctctcttaaaagagcatttgtggtacaaaaagccaggtgcatgacctttgagcaacccctctgtagccaaagagaaagcccaaagcaataccagagcacatttttctggtaatatagcaaatcagacattcagagaaatcactccctgtacagtccatctaaaaaagttggattaaatatttttaaaaatatatggctaaatcaataaaagatttcaaaaattacatagaaaccagaaaggacaaggatctacaaatccacaaaagtatatgttagtactagagctaatgttggagagttccctgaacctccttgcaggacttgtgacaagggtgggcttggcttgtcttttggctggggtttggggtttataagggtacaggatggagggtgtggcaggccaaaaggcaacatttgggtatggaaacaggaatgcctgttcccatttagggctgtaggttttcaggcttgaggctggggcctttgccagggaactgtcctcttctgtctcgtattttcctgcctcctgtccatattattttccctatggccattgctttgggtacgtatttttccatcctcatgttgatctcattctggtgatctctaattgaaggagagactgtgtcagattactttagtctccctcacttaactttttattgctggcagcttcttgtttctgagtctggtcctgaaagtcagagggatgtacacatttcctggttcactcaattcccaaaggctaacaggcattcatcatatgtgactctgctgggtggaaattgggtcttccgagactcagattttaaaaggtctgtgagtgagttgaagaattaggagcagtttacagttctttgaacttgaaattcaaccttctttctttcttctgctcagagtttttcctgtcttgtactctgttttacagagtcctccttgggcagttacacaccattcaaaccactgccctcctgactcctccctctctccccttgcaagagctgtgacttctgaatggaagtgggagaagatcttgtcagggaggggtagaaggaagggaggaaatctagtcctgtaagactttggggtctccatgcagtgggatgtctggcagtctttttttctggtagatatagctcttgtattttataattaagctcaggcagtggggatggacaaagtattttccacatcttctttgtggttcatgctcctgttttacattgctcgtttgctcacttggccatttattcattcctttgataggatttccgagtaaagcagtatactcttggtcgattgtacttcttggtcaatacccattgatcatgcagttcgtggaagtttgactcagactttgagatatggtctctgattttcagttgatatagttattaccaatttttttagtgtgtttctttacatacattttgttgtaaaacagctggctgtcttgtttactcagcagtctgaagcaagtcattagacagctagcaatatttttgactagactagaatgtgagtaacattttgcatggttaatgcatggttgatgctggttttatacaggacttagcaccttgctttgtgcccattgacattgtgagaggtggtagagaagtaggataaagaggcaggaagtagattggttaattccgtgaatttggagaaagtgacttgtctaattttgtttgtctagggcctaccacagtgcctggccaattttgggccctcaaaagatgttggttgaatgaattaaatagtgaacaaacaaatgactgagtgttaaaagaagtttgttcttcaatggggaggaagtagtaagccttctgatgatgcagtcaggctatattgaaagtcaaataatttttagttggcagtttagggagtgattctttctggatgttgaatgtgatggcttctattttgtgtaaacattaaaatgagcgagcaaatagaatattttaaagacccatactgaataatgttttatttatttttacatttattcttgctccccagtgctctagagagttgtaaagaggtgtgacctcacatcccatgacttaattctcccttaggacattatttagatgtgttttatgatatttgttttatgtggagagatgctttttgttagagttgtctgaattcttttgcagggtgttttttcattttcaaaatgcaacaccaaatgaagttgcttcagaaattcttcttgtacagtagtgttatttacactcaaatcaaaatggtttgtggcagttatgcagttatatttgtaactttcctaaaacatataaatgtgtcactgtatcattaatttagatgactcaagatgacactaaaggctgtaaattgccttctttgtcagtgattgagatccaaatgataaattcttagtgcagtttgtttataagctctcaaaaaggcagtaatcttatcttctaaaccttatcttctaaggatgctagttagcatccttctttaggaaaaaaactgtggttttcacatgtatagcattacaaaaaaaacctcttgaaattaagatgttttctgactgaagtgcatcacgcactaggtgatcatacccattcacagaggagttacaacacattttttattattcactgtcattgttcacactgaagaaaagggcagtattctgagagttctcaggtgaagtctgacgctcccagacctaggggaatgtctttacctagagagtgctgctgagtggttaatgttgaaaaagaagtccctttcttgtaatgtcttggttctccaccaggggcggttttgtcccctaggagacattttgcaatgtctgcaggcatttttggttgtcacagctgggggataggaaggcacttagtgggttaaagccagagatggtgctaaacatgatacagtgctaaggacagcctcccacaacaaagaattacctgatcccaaatgcttagagtggagagattgagaaaccttggtccaatgtaatatgagatttcccccctaaattagtagattgaggggagactttattattccgttctgtttttcatattgtgaataagaagcagtagagaaaaaagcagtcatttcttatcactgctaggctacccttcttgattctgaaaaccataggaccatagggcattcaattaaaaagaaaacaaacacagatccttaaatccatcaacaacaaaaccaaaaccttccctgactattctctagtagatactttgaggctcaaatttatttacaaagtaatggaggagagtaaaattgtttgacgtctgttttacccaagtgaggccatctgtattcagtgatggaaataggatctgacaagaggggaggttctgttctaaaattttcttaggtgaagttgttagttttcaagatgactttatcatatggatatgggaagtgattctgtagagacagtacagttatccttcggtatccctaggggattggttccaggacttcctgctgatacccaaatccacagatgctcaagtgccttttattaaatggtatagtatttgtatatagcctttgtacatcctcccatatgctttatccctaaattccttagaatatctaactctgtgtaaatagttatattttaaaatttgggctgggtgcggtggctcatgcttgtaatcccagcactttgggagcacaaggtgggctgatcacttgaggctaggagttcgagaccagcctggccaatatggtgaaaccccatctctactaaaaaatacaaaaattagccaggtgtggtggcgggtgcctgtaatcccagctactctggaggctgaggcaggagaatcgcttgaacctggaggcagagattgcagtgagccaagattgtgcccctgtaacccagcctgagtgacagagtaagactctgtctcaaaaaaaaaaaaaaaatttgtgatatttttaattgttgtactgttttttatttttttgactatttttgcttcatagtaggattgcaggacctatggatctggtgggcccactctattctagaaaattagtaattctggattatgtaatgcttgctatgctagcaggatttactgttatagtaacagcaatgattccagacagttcctggtagtagatatcttacatgctaatgatgagtagctggcagttgagattatcaaatgatgcctctggcctgctctccatggcagacagagccagccattaaaagtcatccagtcgtgggaataaactagactgccccttcccccagtactcttttcacctaggatttcctgtattgcgtttaaggatttcatgtttgaaatccacgtgtctcatttggaaaaagcttttcctgcctttaatttagtataaagtaaaataagaaaatgattgaaattatgaggatcaagaaaaaataaaataaattaaatgaaaagtttcagtttggctcctgttgaaccctatacagtgaagttctctggaaccctctgcattcctccagagtcctccctggcttgatgctctataattgatttgtagctcaccatcttccaacttcctaagtattttagctgtgctgttttggctaaaagtaataacatttaaattctcagttggctgaaagcatctataaggttatattagagaagttttattaactcatataacttccctttttaatggatgctatatatgtgtatgatgtgacattacatttaggggacgaatgaaaagattaggagtgttaaattagaggacaggctcttttttatgtattttaatttaaaaaatatttttgtaggtatatagtaagtgtatatatttaggacagtctctctctctctctctctttgtttttgtttttgagacagagtttcgctcttgttccccaggctggaatgccatggtgtgatcttggctcactgcaacctccacctcctgggttccagcgattctcctgcctcagccttccgagtagctgggattacaggcatgcgccatcatgcctggctaattttgtatttttagtagagacggggtttctccatgttggtcaggctggtctcaaactctcaacctcaggtgatccgcctgcctctgcctcccaaagtactgagattacaggcatgagccactgcgcctggccaggacaggctctcttaaaagtgaggttaccgccactacttttattcttctgtatacaccattgtaaaagctgcgtggttctgagggtggaagtggagtggaaatacgagttgaaggagaaaaaagaacaatgtaaagtctcttgctgttagtaaagaacttgttcatgtatttaaaaaaattttttttttgttttattatacttaaagttctggagtacatgtacagaacgtgcaggtttgtttcataggtatacacgtgccatggtggtttgctgcatccatcaatctgtcatctacattaggtatttcttctaatgctattcctcccctagccttccaccccatgacaggccccagtgtgtgatgttcccctccctgtgtccatgtgttctcattgctcaactcccacttataagtgaaaacatgtggtgtttggttttctgttcttgtgtttgtttgctgagaatgatggtttccagcttcatccatgtccctgcaaaggatatgaactcattcttttttatggctgtatactattccatggtgtatatgtgccacattttctttatccagtctatcattgatcggcatttggtttggttccaagtctgctgttgtgaacagtgctgcaataaacatacgtgcgcatgtgtctttatggtagaatgatttataatcctttgggtatatacccagtaatgggattgctgggtcaaatggtatttctgtttctagatccttgaggaatcaccacactgacttccacaatggttgaactaatttacacttccaccaacagtgttaaaagccttcctatttctacacatcctctccagcatctgttgtttcctgactttttaatgatcaccattctaactggcgtgagaatgtatctcattgtggttttgatttgcatttctctaatgaccagtgatgatgagctttttttcatatgtttgttgtctgcataaatgtcttcttttgagaagtgtcagttcatatcttctgcccactttttgatggggttgtttttttcttgtaaatttgtttaaattctttctagagtctgggtattagccctttgtcagatggatagatcacaaaaattttctccctttctgtaggttgccagttcactctgatgatagtttcttttgctgtgcagaagctctttagcttaattagatcccatttgtcaattttggcttttgttgccgttgcttttggtgttttagtcatgaagtctttgcccatgcctatgtcctgaatggtattgcctaggttttcttctagggtttttatgattttacgtcttacgtttaggtctttaatccatcttgagttaatttttgtataaggtgtaagggagcagtccagtttcagttttctgtatatggctagtcagttttcccaacagcatttattacatagggagtcccttccccatgcttgtttttttcaggtatgtcaaagatcagatggttgtagatgtgtggtattatttctgagggctctgttctgttccattggtgtatatctctgttttggtacccataccatgctgttttggttactgtagtcttgtagtatagtttgaagtcaggtagtgtgatgcctccagctttgttctttttgcttatgattatcttggctatgtgggctctattttggttctatgtgaaatttaaagtagttttttctaattctgtgaagaaagtcaatggtagcttgatggggatagcattgaatctgtaaattactttgggcagtatggccattttcatgatattgattcttcctatccatgagcatggaatgtttttccatttgtttgtgtcctctcctatttccttgagcagtggtttataattcttcttgaagaggtccttcatgtcccttgtaagttggattcctaggtattttattctctgtagcaattgtgaatgggagttcactcatgctttggctctctgtttgtctattattggtgtataggaatgcttgtgatttttgcacattgattttgtatcctgagaatttgctgaagttgcttatcagcttaaggagattttgggctgagacgatggggttttctaaatatacaatcatgtcatctgcaaacagagacaatttggcttcctcttttcctattcgaataccccttatttctttctcttgcctgatggccctggccagaacttctaatactgtgttgaataggagtggtgagagagggcatccttgccttgtgccagttttcaaagggaatgcttccagtttttgcccattcagtatgatattggctgtgggtttgtcataaatagctcttattattttgagatacattccatcaatacctagttttttgagagtttttagtatgaagggctgttgaattttatcgaaggccttttctgcatctattgagatagtcatgtggtttttgtcattgactctgtttatatgctggattacgtttattgatttgtgtatgttgaaccagccttgcatcccattgatgaagctgatttgattgtggtggataagctatttgatgtgctgttggattcagtttgccagtatcttattgagtatttttgcatcgatattcatcaggaatgttggcctgaaattttctttttttgttgtatctctgcctggtgtcgggatgatgctggcctcataaaatgagttagggaggagcccctttttttctattgtttggaatagtttcagaaggaatggtaccagctcctgtttgtacctctggtagaatttggctgtgaatccatctgttcctggactttttttggttggtaggctattaattactgcctcaatttcagaacttgttattggtctattcagggattcgacttcttcctggtttagacttgggaaggtgtatgtgtccaggaatttatccatttcttctagattttctagtttatttgcgtagcttgtttatagtattctctgatggtagtttgtattgctgtgggatcaatggtgatatcccctttatcattttttattgcatctatttgattcttctctcttttcttctttattggtcttgctagcagtctttttattttgttgatcttttaaaaaagccagctcctggattcattgatttttcgaagggtttttcatgtctctatctccttcatttttgctctgatcttagttatttcttgtcttctgctagcttttgaatttgtttgctcttgcttctctagttcttttaattatgacgttagggtgtcgattttagatctttcccactttctcttgttggcatttagtgctataaattttcctctaaacactgctttagatgtgtcccagggattctggtaccttatatttttgttctcattggtttcaaagaacatctttatttctgccttaatttcgttatttacccagtagtcatacaggagcaggttgttcagtttccatgtagttgtgcagttttgagtgagtttcttaatcctgtgctctcatttgattgcactgtggtctgagagactgttatgatttccgttcttttgcatttcctgaggagtgttttacttccaattatgtggtcaattttagaataagtatgatgtggtgctgagaagaatgcatattctgttaatttggggtggagtgttctgtagatgtttattaggtctgcttggtccagagccaagttcaagtcctgaatatccttgttaattttctgtctcgttgatgtatctaatattgactgtgagttgtcaaagtctcccactattattgtgttggagtctaagtctctttgtaagtctctaagaacttgctgtatgaatctgggtgatcctgtattggaggcatatatatttaggatagttagctcttcttgttgcattgatccctttaccattatgtaatgctctttttgtctcttttgatctttgttggtttaaagtctgttttatcagagactacgattgcaaaccctgctgttttttgctttccatttgcttggtaaatattctttcatccctttattttgagcctatgtgtgtctttgcacatgagatgggtctcctgaatacaacatactgatggatcttgactctttatccaatttgccagtctgtgtcttttaattgggggcatttagcccatttacatttcaggttaataatgttatgtgtgaatttgatcctgccattattatgccagctggttatttttccagttagttgatgcagtttcttcatagtgttgatggtctttacaatttggtatgtttttgcagtggctggtacctgttgttcctttccatgtttagtgtttccttcaggagttcttgtaaggcaggcctcatggtgacaaaatctctcagcatttgcttgtttgtaaaggattttatttctcatttgcttatgaagcttagtttggctggatatgaaattctgtgttgaaacttcttttctttaagaatgttgactattggccccactctcttctggcctgtagggtttctgcagagagatccactgttagtctgatggacttccctttgtgggtaacccagcctttctctctggctgcccttaacattttttccttcatttcaaccttggtgaatctggcaattatgtgtcttgaggttgctcttatcgaggattatctttgtggtgttctctgtatttcctgaatttgaatgttggcctgtcttgctaggttggagaagttctcctggataatatcctgaagagtgttttccaacttggttctattctccctgtcactttcgggtacgccaatcaaatgtagatttggtcttttcacatagtcccatatttcttggaggctttgttcattccttttgattgttttttttttgttttgttttctaatcttgtcttcatgctttatttcattaagttgatctttaatctctgatatcctttcttccacttgattgattcggctattgatacttgtgtatgcttcaggaagttcttgtgctgtgtttttcagctccagcaggtcatttatgttcttctctaaactggtaattctagttagcaattcatctaacctttttttccaaggttcttagcttccttgcgttgggttagaacatgctcctttagctcagaggagtttgttattacccatctctgaagcctccttctttcaatttgtcaaactcaccatttttgttcccttgctgctgaggagttatgatcctttggaggagaaggggcattctggtttttggaattttccgcctttttgcgctggtttgtccctatctttgtggattcatctacctttggcctttgatgctggtgacctttcagtggggtttctgagtggacatcattttgttgatgttgatgctcctcctttctgtttgttagttttccttctgacaggcccgtgtgctgcaggtctgctgaagtttgctggaggtccagtcgagaccctgtttgcctagggatcatcagcagaggctgcagaacagcaaagattgttgcccgttccttcctctggaagctttgtcccagaggggcacccaccagatgccagccagagctctcctctatgaggtgtctgtcggcccctgctgggaggtgtctcccagtcaggagacatgggtgtcagggacccacttgaggaggcagtctgacccttagcagagtttgaatgctgtgctgggagatgtactgctttcttcagagctggcaggcagggacgtttaattctgctgaagctgcacccacagctgccccttcccccgaggtgctctgtccctgggagatgggagttttgtttataagcccctgactggggctgctgcctttctttcagagatgccctacacagagaggaggaatctagagaggcagtctggctacagcggctttgctgagctgtggagggctgtgcccagttggatctttcccggcatctttgtttacactgtgaggggaaaacggcccactcaagcctcagtaatggcagatgcccttccccccaccaagctcgagtgtcccaggtcagcttcaggttgctgtgctggcagcgataatttcaagccagtggatcttagcttgctgagctccatggggttgggatccactgagctagaccacttggctccctggcttcagccccctttccagggcagtgaatggttctgttttgctggcgttctaggggccagtggggtatgaaaaaagaaaacactcctgcagctagctcgatgtctgcctaaatggccgcccagttttgtgcttaaaacccaggtccgtggtggcataggcaccggcgggaatctcctggtctgtgggttgcgaagaccgtgggaaaagcgtagtatccggaccggagtgcactgttcctcaccgcacagtccctcaaggcttcccttggctaggggagggagtttcccaaccccttatgcctcctgggtgaggcgacaccccaccctgtttctgttcgccctccttgggctgcacccactgtctaaccagtcccaatgagatgagccgggtacctcagttggaaattcagaaatctcccgccttctgtgttgatctcactgggaactgcagatggagctgttgctattcggccatcttgccagcaacccctcttcatgtatttttaaaatggttaatggtgagtgttaaaatgttgtggtgtttagattttgttgaataaatttaaaagaaagatataatgattttgtttcaacatgtaaatatttatagtatgctagaaactatgtcctttataattttcaatggaaagttttagatgtgaaattaaaaagtacataattttctcaaaaaaatttaaagaagtgtgtgagtgctttgaaaaagccttttttgcctgtagcccaaactagaaaatagatttcttattataacccagcacaggcacccaaatgcgaaagtttataaagcattagttaccatgtataatgctctcaatctttttgccttctttccctcttcccctactttttttttcttcctatttcattccattaaaaaaaaaaagtctggtcttgacctgctaaattgtttacttccactcaagggttggaacttgcagtttgaagcaaacacctaaatctaagatagttttttctttctttgtttttctttcattttttaaaagtctgagcataaataagagaggtggaagtaaaatttatgttaatcaatttaattaattagtttccaagctgttctgtggagctgaaaagtgacatcagtttaaatgtcttctcttgcttatcctctcaggcatctgtacctcttccccattacaccaatatcaaaaactacaaaataaaaaacctaggtgggacggaaaaacagggggagagtctttatgtaatactaattagtagtctaactgatactaaaggataaattttaaaagaggattaaatcaggtctctactatgaatctaaaatctgttaaatactgaacttgttaattaaggagagaactagtgagatactgcaactggttcaaaagagaactcaaagcctcatcacacactgataggcaaataaggaatgtaaaatttataaatggatgcaaaattggttagtatccccggggcaataacgaatgcattttaccagaagcatttttatggataggaattacatgcatgactatcagttttatacaactgatctcctattcctacagatttataaaatagcctagtcaaaacaagcaaaggtgggaataacctgaatgggtgagctagccaggaaatctactgaattctaaagtattaaacaatttttccttctactgattagatttaggctattaattcctaacctaggtctaaaacactttgccacctgaaggccaagtccagttttagaggatttctaccatctgcacagtatttgtaaacatcgtgaatttcttgctattatttaaaacctagatttttacataatagctggatttccagtttgtcttggaaaatcagattgaaatggaatttactattattttcttctcttaagataaagtcccctacttttccttttcttattcataataccacttttccatatcatttctgtacatcccttcttttctcattcaaacttcacccatcttaatccagtcccgtttcagtacaactgtcttaacttcttggctccaggctcttctcagtctctctagcatgctattttacatttaatctctcttaaatactttgctcaagactccagactgcccagtaatgtccaacaaatcctgttttgccactctgaatatgctgacactttcctgacgcttacaactcttcagtaatttatttcttcccttcttttgcagtcttgatttctgttgcttatctacatggttccttcctctagtgaggttaatctctttgctttcctctatacccactatgctttttgttcatgttgatccttcctacaggaaaggccttccttctcttctttgtttatacacatcagatgaagttaaactcaaggctacctagtctgcgcagcctaccagagttctaattcacattgatctttctggaatgttttatgctttctagcgttgttttaggttgtgtattcttatcactcaagattaaagctaccaaaagcatggcctaccttcctctgtactgtattggtatctctgaggagaaattagtaaacttgttgtctaaatttttatatttgcataatcatgcatttcactgtacaaaaggaggaaggttaaacatcgttcaggattttaatttttcagcactgtgaaatttacatatttattgtatttggaataaaatgtgtgtgggtgatatatagatatatatatatacacacacacacacattcatacacatgtatttacattattctgtctatagacagtagctgcatcaatcacacaggaattttagtctatttgatatatttacattaactagtagtctgttgaaattcaaaggagataatcaaattgagaaaaccatgttgcctaatccttttgtcatggataatattacttaaaagggaagccttggagtaataggaaaaaagaaatatattctagtgctctcctacctctattctgaacaataggatctgccctgctaagcaattaggcaggcccttttatacgcagtctgtgtataccattaaaagtcaatacagtgtccttttattttctagttttgtgtgatgcatgcagaaaagaaacattttgctttttatataaagactgtccctgtaacacaaagtgggttaagagatttgagacaattttcccaataattgtgaactaaaacttacatgtgacatctaattgtgtcaataaatttttaaagaactttattgagattggatcagtaacacattgaaaatatacaatttgatgagttttgatgtgtgcttatactgctgaaacagtcactgctgtcaagataatgaacatacccatcacttccaagagtttcctgctactcccttgtcatccctccttcctttgttccctctgtgttcctcccctccccaggcaacctctgatatactttctttcactgtacactagtttgtatttttgagaagcttatataaatggaatcatatagtatgaacttttatattgtctggcttctttccatcagctttttttttttttgagatcgttgcatgttgtagcatgtatcactattttgtttcccttttactaccgaatgggatgcatatggcagtttttaaaaatccatttacctgttattggacatttgggttgtttccattttttggttattaaaaaaaaagttgttacaacatttgtatacaagtgtggacctacgttttcatttcctaagggctaagttatatggtggatatatgtttatgtttttaagaaactgccaaactgttgtccacagtggctgtaccatattacccttctaccacaagtgtacaagagttccagttgctccatatctttgccctttgccaacacttgggaaagtgttttttgtttgtttgtttgtttgtttgtttgtttttgtagatagggtctcatagccctgtcacccaggctggagtgcagtggcatgatcttgcctcattgcatgctcgacatcctggtctcaagcaatcctcccatttcagcctgccgaatagctgggacctcaggcacacgccaccacacctggctgatttttgtatttttttgtagtagagatggggttttgccacgttgcccaggctggtcatgagctcctggcctcaagtgatctgcctacctcagcctcccaaagtactggaattacagatgtgagcccctgtacctgaccggggcaaatctttttaattttaaatattttaataggtatataatggtatctcattgagattctaatttacttttccttgttgactgatgatatgggtcattttccttgtggtggtttgctgttcatgtatcttgctaggtgaagtggctgttcatattttttgcccggtttttattgagctgttttttcattattgagttttaagagttctttatatatcctttatatacattatttatcaaatatgtgatttccaggaattttctcccatttttgtggtttggacagatgaatttatttatttatttattgtttgagacgaagtttcactcttgttgcccaggctggagtgcaatggtggggtctcagctcactgcaacctccgcctcccaagttcaagtaattctcctgcctctcagcctcctgagtagctgggattgcaggcgtgcgccaccacatccagctaatttttatattattagtagagatggggtttcaccttgttggctaggccaggtctctaactcctaacctcaggtgatccacccgccttggccccgcaaagtgctgggattacaggcgtcagccactgcgcccggctgacaggtgaattctttatcccccacctgtatagaggtagctccaggatccctgagtattaagatgcattataggttgggttctagctcagataggtaagttgccactagctaataatgggtttttgagaataaaatttggtatgtttcctgtttataaatgtaaaatttgctcattgtagacaattgaaaaaaatactgaaaactacagagaaggaaatgagactggagtattcttgggaactccaggcggaagtccagctgtcaaggccatgcatatcagaagcaagagtgcttagagcttaccgcatactaggcttggggcagcaggattatacaggtcccttccacttaaattactcttaattctgctaaggattgcctcagaaatatgatgggcagaggttgcagttttttttccctaaatgtaagttcactgctacacctacagttttggatcattgtctggcctatccacttaatgaatgtttatattataaaagtatgaagtaagtgaaggtcttcatagatgttgtgcaggtagtaaatgtcttcacagcatagagctgagcaaggcttgggaaagtagggactgacaaagacagaaatggaattaatcaaatgtatttgactaacattgagaaatattatattaaagaaagtccaacacagacgtcctaagtgttaagtgtttctggtctctgctgctttactgatgaaaagcattcagttttggtgccaatagaatttggtttaagattgtgctctactctactagctatgtaaacttggaccaatacttaacctagtttttcacttcagttcttttttgttcatttaacacagggtcttgctctgtcacccaggctgcagtgcagtggctcactttcacccccgccttctgggctcaagcagtcctccaacctcagcctcccgattagctgggaccacaggcacacaccaccacagctggctaatttttttttttgtagagacacgatttcgtcatgttgcccaggctggtctcaactcttgggctcaagcaatttgcctgcctcggtctcccaaagtgctgggattacaggtgtaagccaccatgcctggtcctactttacttcttttacttacacaatgtgaataattgtgtatacctgtggggctactgtaaggattataggagatagagcatacagtagtcccccttcttatctatggttttgatttttttactgtttcagttacttatggcaactaagtaaaaaaatttatgagtacagtactataaggttttaagagagggagagagagggggaccatattcacataacttttattactatatattgttatagttctattttattattagttattgctaatctcttagtgtgcctaatttataaattaaactttatcatagatgtgtacatacagtaagttctcacttagcatcatggatgggttcttagaaactgactttaagtgaaacaacatgtaatgaaaccagttttaccataggctaattgatataagcaagagttcatttcttatggcatatttctggtcctaaaaacatcaccaacttctaaataaagataaaaacttttctaatgttaaacattgaaatgaatgttagtgatacatacatttaagaaatattaataaaacaagtaagataattatttacccaattattctagttaagtgctacagctggccagaggctcttctggcagcttaagccctcaaggcctcaggaggaaccagctctggacaggaaaccactctattgcagggcactcacacacccacccacactcactcagaaaggaaccatgtagacatgccagtccacctaatggacatagctttgggatgtgggaagaaactggagtactggggagaaaacccacacagacgtagggagaatgggccaactctacacatatatagacagtggccccagctgggaatcaagtttttttttttttctcatcagtattaaaatgaagcaacattacttgggggaaccttttgtataggaaaaaacatactgtatatagggtttagtactattgttggtttcaggtgtctacttgggatcttggaacatgtcccccatggataaggaggaaacgattgtatacggtattttgatatagggtctgacacactgtaggaactcagtaaatgttagtggcatttgtagttattccccttcgcctttccagttactagtcttaggcagggtaactaaatcttgctgtacccctcatagaggggagatctaagaatggtatttgccagtccttttctccactgtaggttacgtttttataccactgtgtgtttttgagtgatatgaaaagaatatcatgggattaagataagctgatggcagattttagtgctttagcatatgttcttttcaggcatggaggggattactcaagatacatggttagactgaccttaggtacctagtggcatgagtctttagcatcagcagcagtattgatcatacaagggaatcccaagactcttattgtaaactaggaagcatgttcccacagaacaacatcttgaggtggactgtagtaggggaaggagttaagttggtggtcagattggtggagtgatagacacgagggtgactgatgcctttgtaataatttcggaactgtctgaaattatccaaagcaaatctttgttgccattctcagttcttttctatagtctctgcctcctttgccttattcctgacctgtttttttccatgcctacacgtttcttgacttttggagcctaaattatccctccttctataatatatttgggatattataatgttctgatgtttggaagtgacagattataatgttatgctttgccagtaagtcatgctatgtaacagactgctgcagccagtgtgtttaaatttgatgttttaggtcattaaaaattttaacgtttcacttaattacttgttataaattccatacacaatacttgggttaaaaacaggttgtttgttttcttatactacacttgagtttagtctggcttttataacaacttaaacttttggggttggagaatgacttattaaaactacttttgtgatatccgtgtttgttccatttctgacttgtggccagacatcaaaaggcattggaaatttgagtccttctgttaaaagactgttattcatatgttagaagaggagccacttcgtaaagggtctctctatatatacaaaagttcttgtagcactctaatggcatgtggcacagtgaacaaggcaagtcacatggccacatctaactccagggagggaagagaaaactgtcctattatgtctccataaaacagagctggtaaacagccctaacgattcggtggttctcatttgtgttcaccatatattcagatctgtctctctactactataggcaaagtaactcacccctccccaaggcagtctgtctcattgccccattcagatatagcatcatgctcaaagttcagtgcctctggctgatacacaagagtctgttcatcatgttcagatgtggtactcttggtctggagacttcatgaactaaaaagacaagtaatctgcccctcctttacccttacaccctggtggaactggtaagcataattgccaaaaccactcccatttacaaaggcgaacaaagggagagagagaacagtcaaaagttgtagcaattctgcaattccacagtagaattttgggggacccctatcttgggcccaagaatgttccttaattatgtccagattctgcttcctgggagaggctcctccatccattgtcttccatgccattggcttcaccctgttggaattttttccttttcggtaacttccttggctacaacggaaatgggcactgggcctccttgggggctgaacagttttctctggcagcttcttatctgtagaaaattggtgtctaagggttgttttaagcattcaataatcatattactctttgaattgagaccagattatttttgcagtacaactctcaaaaattttgttggtttcttatctacttaactttagtcagcttcgtgtgtcaatagccagacctaaaatttttgctagatgtaattcttagatttcctgtatttcttatctttttcacctctgtgcatgcccccctcttctctttatttatttgaggatatcttggctccacaaggcttcagttggagacccacacccttagtctcttttttctgaaccgttttatcccaagagaaagaatttactgagtgccacattagtctacactgaggttttaatatcagctatataccctttatttgatccttagctgaggctgagttttaattagctgttgttccttaaaggccttctcagttttgtttttaactgttcgaggttgaaaagtagttgccttttccaattgtgtaagtcgtttaatttgaaatctattgtcttacatttctgcttgcaaaccaattcttttctgacctcattttttccttgtgggggtttccctttatcttattcagttactttttttcatttgattccttgtcttttcatccttttcttttgctttttcatctaatcttgtttttcaccagtttcattagaggccatctctccttgctctctatagagagtgccaaactgttttcaaacttttcttttgtatctattactatatccagtaagcactttctttaaggatttcagaagctgttccttttttctaattagaatgttttcttcttcacatgacttgtgtttttcttctccattttgaattccttttttaaaagtgaaatctgccagatatgttttctagcaaccaatagattccttttaccattcacttatgttggggttcatatccttctctgatctacaactcaggtcaggccaaccagcacaaatcccagtataattttcagttgctagaaggctttcactcacattaaatcctcaccctcccttcttggttttctgctatgggtgaaatatatgaaaactaaaacttggagcacttgctgccaccaggattattctttgctttctcttttatttttttggcttgtaaggaactgtcctcagaatcctatgtgtccttgcaagtacccttcaactttctccccagttgttttctagaaattgttggcctacttgaatgtataacaatgggaatagtaggaaaagagggttgtgtatgtgtgcttgtatttgtgtgcgtgtgagcatgtgtgtatgagggatggtcacaataatctcaccaacgcaaggatttgcactgatgggaatttaaagttggctgcaattttataatgggtactgatatggtttggttctttgtccccacccaaatctcactttgaattgtattaatgcccatgtgtcgagggcaggaccaggtgtagataattaaatcatgggagccatttcatgttgttctcgtgatagtgagtgagttctcatgagatctgatggttttataaggggcttggcactcattctctccctgtcgtcctgtgaggaggtgacttcccctatgcttttaagtttcctgaggcctccccagccatgtgaaactgtgagtcaattaaatctcctttctttataaatcactcagtcgaggatatttcttcatagcagtgtgagaatggactaatacaggtacagtgcttgagtgtctcaattaggtaaccatcagtaggggatgtttgatgtgttttcttttctccagtggccttagtcttatgaggcttaaggtagtcacaacatgacaagaaacctggacaggtctgtttattttattttttcctatcacccaaaccagtgtctgttttatggttagcaagatccttccagattctcgtgttatctgttgatttgagttttgtatgtagggatttcctgggttattttctgaatcttcagaacttgagagaggttgcactgtgaacttcaaaggatacaggagtttaaattggaagatcattttctagctttgtcggctgacatctagagaaggctcatggttttacatgtggccatagaattcctaagagtaactattgttatatcgttatgctgaactttttgctaaaaagggtaagagttttacagttgcatctgaatttgacattgtgtaatgtttctatttcaggtagcagcagcagcagcagcagcagcagcagcagcagcagcagcagcagcagcagcagcagcaatgtttcacttcttcagaaagcctccggaatctaaaaagccctcagtaccagagacagaagcagatggattcgtccttttaggtgagtctttttaagaaacaaaataattagatgaattatgttctctttaaaaaattacttgaaaattatatgattgattttaaattatttcttataatttcagaattaatttatgtgtttaatttttaaagcgtaaaatctgtaaagatgaaagtcatcaattacttggaatagtgtcatcaagtgagacttttcttccgtgttgatttggctgtgttctccaagttaaatgtgtaaaatcacttctttttccccccctttttttttttaactgtggaaaatctaaagtcttcaagaatccttgatgaattcaagttctgtcttataaatagtactaaccttgtttcataaattagcatctgaaattaaattaggcatccaataaatatttgctgaatgaagtagactttaaaatctaaatatgttaaatagtgtttcctgtttaagactattttctattataaaattaatacctgcaaattttaaaggttttagtgtctttaaaaaatatttcttacaatcaaatacagtgttcttcaccaggggagttctgaaaagtaaaatttcctccatgtcatgtcacatttcttcccctgaggaaaagttttgcacaacatctttgtatgctcttcccagaaattctctttccaaagtatggtgtggggtagtcaaacccagtgtttccttgtggttctcatccttttccatgctggacctcctcccaccaaattcctactccttctctgagaagatttgcattaactcatatggtcttcactccctggaatgtttctctgggtctccttttccagatactggtttcctacctcttacttcctttatcttggccccatcagactggcatctgctagcatcagccaatgctctgtaggctttgagaaataagggatgtttcccttagatttaagggtaatctctgtgagaccagaatagagtttttctcgtggataaactttactatagaattttccatcatttctacagccatgttctggcaggcctgttgtttttgagaacctgtcttgtatgtccagggacaggagcagtagctgggaggttgctcagaattgttttcttcagaccagatcccttatacctgaggtaaaaatagtggggcttagtctttgaccagggctgatgatttttctgggtagccttctgactgggataaggtagggtgcagtggacttaattgctaatatgacccttccttcatagtgtgtcaggaatttatgccttggcttccaagtcagaactgactctgttaactccgattttagttccttgaaagctgccagtgttacttttttcacacttcttgaattagcctcgctaacagaaaacttcaggggtacatcaggcctcctgtgaagtttctctttttcaggagtttcacaataaattcttctctcagaattttttccaaaaaactcttgttttccactctgttatatattcctgattttaaaatacctctgaagtcttaacacatatacagggaactctgcttttttctgttgtttttattatatatgtatttaaaattttttttaaaattatttttaaagaaaatagagatggggtcttgccatgttgcccaggttggtcttgaactcctggcctcaagcaatcttcctgcctcggccccccaaagtgttgggattacaggcatgagccaccacgtccagcctcttttctgttgtctttatgattagaaattgacattattctttttgttatcaaatagccatttagaggctgtaagttgggtgtactggcatctttgaaagcacatagaattcctaatgctggaccttaaactttttattcatctactttatccctacttctctgccactttgtaggatttctgagacaaattttaaccaccactgcagtggctcctggtgctgctaagatctcctccaatttctggtagcatgtagtcctgatgagacattccattgcatgtcttgtagctatctcagtagaagcccagtttccagggccttctgcctccgagtattatctactatggatctcctttccctttccaggaaagactagtttaagaagtagtctttctttaactgagcctcagaaggcacacaaacttccaaatttcgtattttaagaaggaatttccgggacctaattactctaatatgctctcagtaccagctgctccatctgagggaattttcccaggaccatcttggactagcataattggtgtcgtacccagcaccatatgtctagcagttgaacagtcatggtgaggaatcacttccgtcgtagttccaggatagcagtttaatttgcagtgcagctggtgctgtacctggttcaaatgacccaaacaaatcaggtccgccagatgttggctgaggcctcgttgcccttcagctcctctgtctgctgatgcttgtctctgtttagcctcatttccccccaggtgcaaagctccaccccttcaccattttcataaaatcctctgtacatagtcttctgtgggtaccattactctcctgaagttttgatggtatcagtcagcatcatgtctcagctcttacttcctctgtcttcgttctcttttcatcattcatcccctcttccttcttccgcagaagcatctcagaggctctccagtgacgtgctgttaaaagtgctgaccctgggtcagaccctttgggttggcttcgtggctccacgacttactctctacccttggcaggttagttacccttcccagtaccacttagcatatctaggaaatgagcacgatatcggtacctaccccatgaagttattgaggggaataaatgagttaatgtgtgtaaaatgtttagaaaaaccctgtgagtgaggtagtactattatatcaccatacacaggctaggatttaatgtttccaagtttctccagttagtatgtagcagatctggaattagcccaggcaatctgacttcagaacctatcctctaaaccactgaactatccatctttttgtaaaaaaagttatatcatcagttttaattctaagacattattgacatcctaacctctttgttttttaaaaaaagttgtattctctacaattgaaaagagaaagtgctgttttttatttgttttaataaaagaaggttggtggttgtaatactgttcataaagtttggcttttattttggctaacccaaactttttactatttaatagtttaaatgtttttaaaatattttaaaatatttcagaaaactccttgatgaagttgaaattggaagttggtatatatggtttaattagtgaaaacatccttcagtggtgaagaacttaactgaattgacagataaagatcttgacagattattaggaatatagttaattgtctttaaagttatagttaattatcaggtaaactcttttttaaaaaattgatttgctctgctaggtttctctttttattatatcattctatactgacatatataatatctactttagtctcagagcatactgtataaaatattctggaaaaagtcaagtagatcaaatggtaaatagaaaatgcttttaatgcttttattaacatggacacatacttgcacacatctgttttgttttaaattttttatttttaatcattatgggtccgtaatagttgtatatatttacagggtacatgtgatgttttgacacaggcatataatgtgtagtgatcaaatcagggtaattaggatatctatcacttcaagcaattatttctttgtgttagcaacattcaatttccactcttttagttatttaaaaatatacaataaattattgttaactatagtcaccctattgtgctaccaaatactagatcttattccttctatctaactgtatttttgtacccatcatccatccccattttatttccctctttctgctacccttccttgcctttggtaaccatcattctattctctatctccatgagttcaatttgaaaaaaactgagctccctcatatgagtgagaaaatgtgaaatttgtctttttgtgcctgctttatttcactttacatgatctcctctagtaccatctatgttgttgcaaaggacaggatttcattctttttttatggctaaatagtattccattgtgtatatgtaccacattttctttatctattcatctgtttttttgtttttttttttttttttttttttttttgagacggagtctcgctctgtcgcccaggctggagtgcagtggcgggatctcggctcactgcaagctctgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatctattcatctgttgatggagacacttaggttgattctatatgttggctattgtgaatagtactgcaataaacatgggaatgtggacgtctctttgatatgctgatttcttcttttgggtatgtacccagcaatagaattgctgtatcatatagtagttctgtttttagtttttttgaggaatctccatactggtcttcatactggctgtactaatttacattcctgccaccagggtatgaggtcccttttctacacatccttgccagcatttgttattgcttatcttttggattaaagccattttaactgggttgagatgatatctcattttgattttgatttgcatttctctgatgatcaacaatattgaacgtttttttaatatgcctattggtcattttgtatgtcttgagaaatagctattcagatatataaaaaaatatatttatatattatttaatatatatttaattttatataataaatatatatttatatatttaatttatagataatatatatttatatatttaatatagataaatatatttatatacttaatttatagataaatatatatttatatacttaatttatagataaatatatatttatatacttaatttatagataaatatatatttatatacttaatttatagataaatatatatttatatatttagtttataaatatatatttatatatttagtttataaatatatatttatatatttagtttataaatatatatttatatatttagtttataaatatatatttatatatttagtttataaatatatttatatatttagtttataaatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataatatatatttatatatttagtttatagataatatatatttatatatttaatttatagataatatatatttatatatttaatttatagataaatatatatttatatatttaatttatagataaatatatatttatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatatatatatatatacacacacacatattaagaggcaataactcactatgttactcaggccactttcgaactcttaggctcaagccatcttcctgcctctgcctcccaaagtgctgggattacaggcgtgagctgctatgcctggcctgcccattttaaaattggattattttattttttcctgttgagttgtttgagttccttatatatactgattgttcatccattgtcagatgagtagtttgcaaatattttctcccattctgtgggttgtctctttactgttgattaatcatttcttttgttgtgcagaagccttttaacttgatgtaatcccatttgtccatttttgctttggttgcctgtgcttgtggggtattactcaagaaatctttgttcagattactgtcctgtagcatttgcccaatgctttcttctagtagtttcgtagtttcaggtcttagatttacgtattttatccattttgatttgatttttgtatgtggcgagagataggggtctagttttattcttctgcatatagatatccagttttcccagcaccactgattcaagacttccttttcccaatgtatatccttggcacccttgttgaaaatgagttcattgtaaatgtgtgaatttattcctgggttctgtatttggttccattcgtccatgtgtctgtttttatgccggtactgtgctattttagttactatagctttttagtataatttgaagtcaggtagtgtgattcgtctaattttgttgtttttgcttagaacagttttggcttctctgggtcttttgtgattctatataaatgttaggattattttttccatttctgtgaagaatgtctttggtattttgatagtgattgcattgaatctgtagattgttttgggtagtatggacattttaacaatactgattcttccaatccataaatttggaatatctttccatttttttttatgtgtgttctctttggttgctttcatcagtattttataatttttattttagagatctttcactttggttatatttattcctaagtattttattttactggtagctttataaatgggattactttcttggtttctttttcaaattgtttgctgttggcatataaaaatgctattgatttttgtatgttgattttgtatgccgtaaccttactgaatttatttattagttctgatagtttttttagttgcatacacatgtatcatggttagcatatatccacataactttttttgtggcatcgtgtgcaatacgtacattacagaaaaataaatatattttgttggtttgtgtgtttgttgatgtctaaatgataaagctaagtaaaaacttataaacatgattatatttgtagcaacaactttttatcaatatggacaccacagaatttgttagattatctccttatgtggcctttataacccatttctagaaaggtcagagtaaattatgttgtttaagctataaattatctatttttttccacttgagaataccttttcccctaggcaagcatttctgcttaacacaaataggttttaggtcacaattattagatggcattgcagagttgatggaatcaacacatcatgacttgaaattcaggtctgggcagagtctagacacttgttttggtaataggaatatctgggctgttcatatacagttagctcacatttggacagaaaacctttctccgcattaagatttcgaaagcttttagcctctgtaaaatgtctagtggtgccgaataagaataagggaaaaaagttcttgtagaaaaacatcctttcccttgtaaccagttcctattcacgtaagaaggtaatagctattccttcattcagtaatgaagttgaagtaatcctccagggtactcattttacacaaaaacaaattgcagttttcatttgcatcactgggtggcgatttttcatagccttatactactatttaaaaatccagcaagcatggcactattcgtaattaccagggttttctcctgttatgacatgtttaattgtacttttaagacattatctttaagttgattacaaatttactagtgtagtggcaagctcatagttattttaagttaggaaaagggatattgcgtaaatgttaggatataattccttccaaaactaagacaaaagcatgaattagcttattatgttatagcaaaaagaaggaaaaataacaacaaaaagtaataggatataaatgaaaaggaacaatttagatattgttgttggttcactaatattgttgaccaaatattgaatataactttgaagcaggcagaatgaaattgggcaaacactattgtagagattaaaggaattgggttacagtacaagggaaatgcatcatggttttcagaatatgcaggtgcttcttcaagtagggcataagaacttctagtttccattaagctaattattttgtaacacttgctgaatttagaaccagaatttaataattcacagcagcttggatttcaccttttaaaatacttaaaacacattgaaatatgtaatttagtctcaccttctgttttccagtctcaatgatcagtcagatattgaaaataagtgagttatttttaagattatctcctatggaattcctcattctgggaaccaaaccacatatacatacttcatttaaactatcatatttttatatggaacttttaaaggtagtctcttcatcgctgtgttgtttcctttatttaaaagtggaaatttagctgtatacataaaaatttacattctaaggaatgagggacagtaagtcactttgattctgtctagggttgaaggctttaattaaaacagtgacaaaaactaaacaggttttcaacatgtgcttcctatttttattgcctgttcttacaaaaaatgtataccagatctttaaaaaattagagtgtttatggattaaaaagtaacttaccctatcgctgtctccttacccacgtatcgggatatccagaaaaactcgatttacatttaatttacttagcagtttttgtgtttttacttttgacctttaaattgcaaagcaagtatgccaggatttttcaactaacttcatgatgtagatgcttgtttttctattaagaaatgtggagttgtgtgtctaatggatagaattaacagtattttcagtcactgttacctgattctggtttacctgttaatctagcagcgtttcagtttcagtttttcggaggtgaaaaagttaggttaggccatccccgtgtggggtacaccacccttccttaactccttgaatgtacagtgaaaggcaattgcatgaaggaagaggagaggtgccaactgtactcagaggcagaactgagccttctgtttggcacagttaattgtgggaaagtcattcatttttttcggggactcagtggatttagttgactcaaacgtaaattagggatctatctctctgtgattctaacccttctgtgcattaggggatacttagaaaaaaatactggtgctgggacccattcctagattctgattaaaaggtcctgggattaggcccaggaattgattttttccccccagagttctccagatgattctagagttcatgcaaggctgagaagcactacagttcactctctaataattgtatgtcatcaaataatgtgttgagacactttgaaaaagacttcataaaatataaagttacagtttcttttttagttgagccataaacaaaaagcaaataaaaccacagaatttctgggtaattacatttccttcaatatattaaatcattaaatagaaaaagagcagaaagcttcatacatgatcctatgaaatgaaatttgttttcttttccttttcttttttttagacggagtttttgctcttgttgcccaggctggagtgcagtggcatggtctctgttcactgcaatctccgcctcctgggttcaagtgattctcctgcctcagcctcccaagtagctgggattacaggcatgcaccaccacacctgcctaatttttgtattttggatagagacagggtttcaccatgttggccaggccggtctcaaactcctgacctcaggtgatccgcctgccttggcctcccaaacagctgggattataggcgtgagccactgcttccagccaaaattcattttctatgagtaatatacagttttcccttggtatctgtgggaaattggttccaagacccccgctcataccaaaatccattgacgctcaacgctctgatataaaagagcatagtttttgcatgtgacctacatacatcctcccatatactttaaatcatccctagattactaaaatacctaatgcaatgtaaatgctatgtaaacagttgttttactgtattgtttgaggaataatgacaagaaaagaagcctgtacatgtttagcacagatgcaattttttttttttttgagacagtgtctcactccatcacccaggctggtggcagtggcacaatcttgactcactccaacctctgcctcccgcgttcaagcaattctcatgcctcagagtcccaagtaattgggattacaggcgtgtgccaccattcccggctaattttttttttttgtatttttagtagaaatggggtttcaccatgttggccaggctggtcttgaacttctggccttgagtgatccacccctttcggcctcccaaagtgttgggattactggcctgagccaccacgcttggcaaccacaagcaatttttttttctgaataattttgatccactgttggttgaatccacccatgaggaactcatggatacggagggctgacagtttttgaaaccttagatgttttttgaaaaatcagtggaacaactgggaagcattttattaaattaattatacaatgtgaattccaactgatctatgactctttctggctttagccatagtacaactatgaatttatgtgaaattatttgacagattaacacccgtaaacttttcaaaccaacatctgaggtaccttttaaaaatcagactaacgcattcaagcagccatgttttaatacaactatttgggggtagttgactgtttcactatggtactatttccttgaagggtgcttattccatacaacatctgtagggaaaacattgtaagtatgcataccatgttatgtacatggaatttctcctactgtttccttacaggctttactaatgctgtaacttcacattttgtcagatttaactcaaaaattatgatgagtggctttcatatttatttaaactttattatttcattatattaaagatatagataatgaggatgagactctaagtaaaatgtacagtatgaatattctaccttgtatgagtaattcatatagggttggaagacctgaatgtctttctggtaatcttagtactacaatattcttttatacttaagtaattatcatattgagcatctgttttttttattcattgcatgcaaccaatgcatattatgaagggaagaattattattgggtttacacattgatcttttttttttttttgagacggagtcttgctctgtctccaggctggagtgcagtggtgccatctcagctcactgcaacctctgcctcatgggttcaagcgattctcctgcctcagccttccgagtagctgggactacaggtgtgcgccaccacgcccaccaagttttgtatttttagtagagaaggagtttcaccactttggccaggatggtctccatatcctgacctcgtgatccgcccgcccctgtaatcccaaagtgctgggattataggcgtgagccaccgtgcccggccacattaatctttataaatgtgaatttctaaaaaatttaagtgttggcccacttggtttctcaagttgcctgcctgaccctcttcgaagttgtacttttcttcttttctttcctttccgtactattctaaagctttttaataaactttcactcctgatctgaaaaagaaaaaaatttaagtgttttcttccttcattatatcatgatagaattatggtcttaccttggaagaatagtatctcataaaataagtaagaagaatgtggtaaattagtgtcgtatctttttttgattgtagtaatcagtaagtgaacattcttgagcactttctctatcccaggtgctctcctgcttggttagggatgctccagattcctgggccttgcccacacctagtgaaacagaattttgggagctatagccagagaatcagcattttaagcaagcaatgcatttagtatagctacttgggaagagttgactgttttactctacagtatttttatgcatactgatgtctgagaattgctggaataattatttttataaggtatggtagaggagcaaaactattctaggtggtggggcagattgtgtaaagttatatagcttcagaagaatctgatacataggcagggccagtattcttggctgaatagagagggtgtatcagggccactattgggaagtgtgtccagaaacatggtttgtgggccttgtgtggccttctcaaatgttagaatgttatcccattggcagtaaggaactatcagaccattttaaagcagtaaagttatgggttttgtttttttgtattttttatcagaaatttattgacaattttttaaaaatgtagataatttttatagtttcagcaagattgagaattatcttttaatgaaaaaactaattgcagcatcatgtcctgaatgcattactgagaaggcatgcacgtatactcatacgaggttgacagagtaagtcagagaaaccacaacaacaaattaataaactttccagaaccatcatgctgcaaagttatttttctgaacacctgataatttaaccttttaaatcttctttagcttcactgtgatatggggcagacactactagtccctcaatatctgtttccccctttatctttccatgtggccgttttccagttaggtgtgaagattatgatgaagtttctggccaatgggatataagaagaaatgttgtgttgcagattctaggaaatcttttaaaaacacactgctgtgtaccttccttactcctctcccctgcccccacttcccttatcctggaatgtggatatgatgattatgtagaattctagccagcatctaagaccatgagaactagggtacgttgtaaggatagctgaagagtgaagtcaaagagttgtgaagttgccataccagtcctttgaactttcctttgaacttcctttatgtgagacacaaagttctgttctgtttgagcaactattttattatgtgatttgcggatgaaccaagccctaagtaatacaggtactgaactggaaataatagtatttggattctatttaagttctgtcatttacttgctgtgtgattttgagcaggctacttaccatttcagcctcattttccttttgtgtgaaatgttaatgatatcatggtgtcttcattacattgttgcaggagatgaagcaaaaggaaactgtacacagatctgcactgacaaaagggagtacaaagaacttgtaattcttttgctgaccctgggcagttcagtgaaatgcttgggagaatgattctgaggtagcacttagtttagctggagagaatttggggatcactaatgatgtatgttgtaggcaaaggaatggtgtgcaccctgccagggccacatataggccttccctcaactcagactggaaggccgatctatgcttatatgatcagtccaccagaaagtctattcacacccactaaaagctgaagtgtttaaagtgtgcattaactagcagaacattattaaagagaattgctgccaaactctggttgtcagttaaatttgaaaaggattcacttcctacaaccggtatttccatcaaaaatgatatgtacttttatgactatacatacacacacatatttttaatgataagtattaaatacatgatattcaaggtttacactatagtgttactgatttaaaggagtaattgctctgaaaattttaagtattctaagtcaaataactaagctgtaaatttatggaacgacttatttttatttctggcatccatcatttcctgatgcaccagctgaaaatatgcttggcagcaccaaaggaaaactgtaacccctgaaatagcttgttgatggatggcttgaagaagttgataactgagataagcagccattgtccctgttgctgttgctatgttaggggttcttaacccatgttgagtttggagggctgcatgcagtggtctggaaacttctgacactacatgtaaaattttaggtttgtatttttggggggagaacattccctgcattacatcagattctcaaagatctgtaacccccaaaatattaagaattacttttttagatgttgctttggtttactagctccttgggctgtgatttcttaggatatttttatcttaatggtaaaggtgggagagttgttgtcaggtggggcatatctcattgggtacctttactagtttggcgtcagaaagtagaatgtgagaacctttttacttgttatcttaaaaaggaaaacttacttataattagtagtgattatttgctcatggtttgccttttcactgattatccgaatccaaggtgtttttctgctgccttgccctcagccccgtgtttcctcatgcagagtgcccagcttgtttcattttgtctgtgtcgtgttcagtgtcaagatctcagatgaaatctgtctcgaggcttcctcagtttctagatagctctctttttgatctcatgttgtaaatcttctatcatttatttgcttcttaatcacatggtattttgtagcagctcctatattattgttttgtaatgttatttacgcctttatttttgtatgtcttgccaattatgttgtaacctcctaaaggacatctaacccgctgcgtattttataaaattgtaagcacatgactatcaaaaagctgatcctcagtctgtatattgttaatagcttttgtaatgacttgtaaaccatttaatatttggttagaaaacttggtaatatcttctattaaggtattttctccaatgaaaataagtctttgttaacttatctattacttggatttaaattatacttactttatttagttatataaatgcaaattagtaagcattcagactaagcctgccttactctggggaggaggggcttcctttacttccctacctctgcttgaccatgcgttttaggagagccaaccttattcccagccccagaaagtcagtgctcatttgcctaagccagtcacggtagtctaattcaccttgccagtgattggcttaggaatgggcacccatcacatttctgactgcgacatgaaggaagatcaactgagagactcatgggcagatacagacagaagagactgccacctcttctcgtggcagttatttgatctggatgaaatggctgatgatgttttatctatcattgccaactttgcttaggagagctagcttgagacagaggtcacatgtcgaagatggcagagtaaaaggaggaagcaaccatgatgacattgttgaactgacatattcactaatttgggagctgtttacctctggactttttaggtgagataataaattcccgcattaaagtttaagccacttttagctaggtttatgttacttgcagctgaaaatgtctgcaccgatgtttgacagatgtgcttataatgctatctccctggataatcttttcttggtagagcccctgtttttcatgcccagacttcatggaaatgtatttatatgtatatctcagtaaagctcttcagtctgtgtctatatagaagacatttatatttatgtctttctaaactcaaaacaattggaaatagtctggagttcaattttaaatgaaattaatagattgtcagagtcataagtaaacattttgaatggtatactcactgccatcagaaatgttgtgcattttggatattgctggtaccaagggagaccatattactgctacaaagcagctagtgattaacaaccatagtaattggtgatcaggaaacaagttaaacatgctcacataatagtttgctacttatatataggtgtttttactgtgttttagttatgtcttaagaaattggttgagggttttagatgatatattccacattgtaatttttcccatctaaagtgatgggaaataagcttgccattatattttcccacccatttgattttcaggaacgtattactgatattaggcagggattcctttactaatctggaccagctatgttattaagtcagcaattctgctgatgataatgtagtctttaactagcaactcacctgtatccctcacatattttaaatgttacatatttggaaatgtatttccaaaacgctgaaggcaataaatgaaaccataattttttttttaagcatggaagttcaggagaaaaattgaagtgtatatgtttccttttaccatcccaaatttctagttacaaaatcactttataaagtttaaaaccaagtatatattatgtttttactggagttgaacattaatcatgcccagtatgtcagatgtgaaagaagagttttaaaggtaatgaaaaatattgtattaatcttatttttaaatgtttacttttttattataaattgagctgcagttttttaatattttgcaattataaggtgggggtgatgccgcacctaagttttagagctaaaaggacatcttagggataattctaaacagccacatatgtaaatatttctgtttgatagttatatattgagaatactttaatatatctaaattcttttgtttttgctaaggagagaaaggaaggtaaatatagtattgagctaccttatatgagttgccaaattatggtatgaaccaattatagtgaaagcattcccttcacatataaatgcttttctagcctgtaggcatcttttcattgctaaagttgggttaaattttcaccacagaaattcaattatgacttatacctgttatgaaaatatgtaaatacatcaaatatattttaatgttttaggtccagatatatttaaatgttttttatcccctaaaggagtgcagtttctttctgctccttctaggtctccaaagttacaggaccttgaagcatgtagagctcagcatggtacaaacctgtatttttcaatttgtgctccatgtgacccttcctggaactgagcagaagtgttatgctgccaacattgaataatggtggtcttttcacagtttgtaggggaaaaaagctgatggaattttaggtttttcattccaaaattttccttaaattctagaaagagccaccattaattttcaagcaagtattaggcaggtaaaatgtatgtatgaggaaaaaatggttattcaaggaaaaaaacttgtaaacaactgataatatctacttttataactgttctttagatatttgtagtcgtcatcattattttatattcaattaaaataaaccaaacattaatagcaatttaaacttagaattactaaatacataatttcatctaaaatgatagtttgtatgatagaatttaaaatatcagtatttactactgtcctgcaaagagcattttgacttcaagccttgcatgacattcactatatgaagagattacatttcgaaggagaagatgggaactctgctgcttattttctttctcatcttacgcatttcagatcattttgctggggcatagattctctatccagtgactgaggaagtaaattggatttttatctctaaagttttcttagaaagagctttacattttagtgacccttttttgttctatgtatttaaagagactgacaaatccctaatttattctaatctttatcgaattaaaatttgatggtattgaagtgttttctgatacatggagttctttctcaggagggaaaaaggtggttcaccagctgccaaacaaaagtcatgaagattttttagttaaaattttatctggctagtagctcagtttagccttgactaatcttgtattaaaatactcatgcaaatgtggaaggaaaaattttataactgttccaaaacttaggaatgacagtttaatgctagaaactgaggtgaagttagattgagaaaaaactaagcttctacacatagtacagtatgttgataactgcagttattaacagctattcctctttacccctggggttccattctgtaaatgaaacagagtacttcgccccctttttctgcactctcgcacacatatcaccatcttcccttactctggaaagcagctagtcagcaggtagagaagggactggtggtggtggtggtggagggtgatggggaggtatagtctagtcctcaccaggaaaataatgtgggcaggaatagagacaaaaattggtgctgctagtagtcatgaggagaattataacttttttcttgtactcctgcagaccacgtggtagaaataggaggagaaagacattccaagagagaagaatgacactgaatgaaagcccagagaaaataggcaaatggattgaatgctatgggcacccacctgcctctaagctggtggaaatttatattcatacagtctttgtggaagacaaattgtcaatatgtatcagaagctttaacaaggtagatcgattccctttgccttagaaattccacttttagtaatttatcatcaaaacacaagcaaatgcattttttgtttgtttgtttgtttgagatggagtcttgctgtgttgccaggctggagtgcagtagcgtgatctcagctcactgcaacctccacctcctgggttcaagtgattctcctgcctcagcctcccgagtagttgggactacaggcctgcgccaccatgcccagctaattttcgtatttttagtagagacggggttcaccatgttggtcaggatggtcttgatctcttgacctcgtgatctgcctgcctcggcttcccacagggctgggattacaggcatgagccaccgtgcctggccaaaatgtggcttttaaaatggtatatttcatgtgaacctttttgttatgtatattttatgtgtctaaaatagctgtaggaggaaaaacatttacctaaggaccatatgattacaggtaatttaatcttttttcttcctgttgattacttatatctacttcattattctgtaatgaacaagtattacttgtataactccaaagtcaaaaggaaccccaaaggtatatatatgtccctgaattcttgaatctctcagggagctgtagttcttctaaaagcagaagtacattttactattactactgaaattgtactgtgcttcttgtttccagtatacaattcaccaaacatttactaagtaaatatgaatagttactcttaaaatatctttatctatctatctatctatctatctatctatctatctatctacattatttcggtagacttaaggccaatgtataatataggaaaatctcatctgaaactttcccttcattctgcaatagcttagtaatgtatagactttccaaggggaaaagatgttttgggggaagaagttaaccaaatttttatttgggtttctctctcatgttttcctggatgtcgatagttcttttattctcaaaagagcttcatgaaactagaacttccagtgtatcaggaggcatcctttaaacattaaggtctattttaaggtgaaattctactatattttaaaaattgtttatttaaattctataacttttagtggattgcacaaatttatgccttgtttattttataatgactttattacaattttaataatttagcaatattatatgaacgtgaagttttatatccttctttaaatattttgtaagatgtttatgtgatattttaagtttaaacttataaactctaatcatattaacactacttaccatgagtgtatgtaataatttttcctctgtggtgggtttttatattgttaataaagttatatttcatattatcttaaaatggcaattattaaaaagaagagctttccctctgaggactgagatctctctttttgttgccattattgtcagttgttctggaatactaatgctttgttgatataaggcaactgagtttttttcaactgagtcattagacacttgaacaagagcaaagctttagatttttctccatacctatagaggggcactatgaagtagttggaaatttgtctgtgtgagtcatatttgagcattccaaagaaggaatgaagcatgttttctttttctcctcatgactagtgataattgagtatcttttcttgtacttattggtaactttttatttttaatttttatgagtatatagtaggtatatatatttatgggttatatgagattttgatacaggcatacacatataataatcacatcagggtaaatgggatatccatcacgtcaagcatttatcatttttttgtgatacaggcactccaattgtaccccctcagttattctaaaatgtataacaaattattgcagactgtagtcaccctgttgtgctatcaaatgccagatcttacttattgtatcaaactatgtatttttgtacccattaaccatctccattccccaccccacccccaccactgtccttcccagactctggtaaccatcattctactctctatctctctgagttcaattattttaatttttagttcccacaaatgagtgagaatatgtgaagtttatctctctctgcctgacttatttcacttaacataatatcttttttccatctatgttgttgtaaatgacaggatctcattcttctttatggctgaatagtactccattgtgcatacgtaccacgttttcttcatccattcatcttttgatagatacttaggttgattccaaatcttagctattgtgaatagtgctgcaataaacatgtgagtacagctatatctttgttatcctgatttccttccttttggggatacacctagcagtgggattgttggatcatacggtagttctatttttagttttttgaggaacctccctactgttctccatagtggttgtactaatttacattcccaccaacagtgtttgagagttccccttttgccatatccttgccagtgtttgtcattacctttcttttggataaaagccattttaactggggtgagatgatatcttgttgtaattatgatttgctttctctgatgatcagtaatgttgagcaccttttcatatacctgtttgccatttgtacgtcttcttttgagaagctcgctgtttccaagtagagaaaatcactgttgctgccaaccaagtagccgtgcaataatttgtttacttgctgtcaacattttccccaccacagtttatctcatagagaattctcaagcccagccaactttaagatttcatttgtaacacagaatgattatgttatattagataagaaaggctgtagagagagaaaaatctcctaaccttgtctttctgtcttttctagacataatacgttgattttttttactctgattctgtccatttaatttttattacatgtttctcaaccatggtctttccttgttactttcaggcatagaacttcctaaatgtttagtctcagagcaagaacactcaagcttttcatgttctttggcactagcagccgtaacacattgaatttctggcagtggaatttctactcacaggatctgacccctcacaccatggccctgaattaaaaaagacattgcttctgagcatatgcaactcagcaaggatcctcaacaacttgtgtcctatgtagacctagcatctttaatatctatgtatgttgggaattatctgtcaatgtgtcacctttaggttctttatttttctacatctgtcttctgtggtcataaatgctgattataagttaagcagcagtgtgcacactacatcttatgcactaatggttggatttagtatccaaccatggcaggagtgtgaaacagtgagatggatcattgacctttgtctataggaggctcttttaaaccctactgtgtatatctccgttttttttttttttttctgataaacttaccagtgtaatttttttttgagatggagtctctgttgcccaggctggattacagtggtgtgatcacagctcactgcagcctctacctcctgggttcaagcgatcctcccattgcagcctcctgagtagctgggactacaggcatgcaccaccatgcccagctaatttttttattttttgtagagatgggggttttgccatgttgcccaggctaccagtgtaatttgttttctccttgaactcatacaagactcactcttttagccaaagttggtaagaattattaggtagattaaaaaaaaaaacaccccaaaacaaatgtggtctgatggtgaagtatcacgataaagacaatttgtaaaaactgtgaaatcatattagatcttagtataaaattctaattttctataaaaaaatacttcttagaagtcctgagcttagccactggaactggccacaagacctgatttgggaagaggtaacctgttatatgaatttagttagtaaaattgtagaaattcagatgtcatttgatcccagggaagtgtatttctccccagctattaaccagtgtcaactgtctgaaatttattgatccgaaggctcttcctcatttgttgccagtagctctccctcatacagaacaaatgactcacatgctcaagctaaataaagcactccgtaaagatttttctgcctctagaactgctcaaagtcagctctcaatagtgggcactgattcttgccaactggtttacccttattaactctataggtagggccctgtgaaaccacactaacatgtagatgttctctctttttctttcttcttctttttttttttaaaggctgcccttttcagacattccttctgaaatctgttaagaataacataagactagtcacagatttattgatttttcctgggcatttgactatgtgaagtggaaccagctatgacctaagcttagcaagctcagtaaacaccctctctttgctccaaggtctgtataacttctgtcttagtacacatgccaagcagtcagcaggaacggtcttgtggtagatgagatgattttcagtcaggataagtcagattgttttgcttttctttttatttaaaaaattattttttcaccctttaaagtcttgatgatcataatccacttcttgatggaatgtgtacctgacactttgatacactttgcaacagtcctgattggctttctgaacagattccttattatctaggaatgatatcttctatctaattattttcccaaataactgcttagtgtttattgctttaatatcagaatcctctattctgccagacaagttgcagcatttaatttgttttcttctaaaacacctatgaaacagataaattatccattttatttcatttcctgtaagttattttcttaaaacaggtatcttatgggtacatactggaaactttaaaaaatggctaatgtaaaattcattttgaaatatgattgtggcttccttttgtggcagtcctgctcaaaattttccaagtatctcaggaaggaagaagcacgaatatgtacctgctaaagcccttggggtgggcacctaactttaaagatatttttatttttttaagctgatattatcacattcatgtgacattggcacccagtgtgtaatagagctgtggttattttaacataaaatgctttaaattatggatcatcaggtagtaaactggaggatatgagatttactgtattttttccttgtcattatgcctcttttcacatggtgcatgtactcttgggtatccatcttccaatttgagacgtataaatcagagtttttcagttgcttaaatgactctctgtttgagaccagaagtgttttcagaggaaaattttgatattccctcagctcaccttcatgagggctgtgaaataaaaactttggggagttgcctggattggattccttagcaagctgaccccactactcatttgattgttagaatgtgcatttcttttaattagaaatagagaatttctgcacttcacgttctggctagacaatatgttatctgaatcaaatacttactaaatgcccatgagttagacactgtgctgacaggcactaagaataaacaggtagttctatatctgatgtgatattatttattttgaattgctatatgcttcattagtgtttttggatgaaatttagtaagatatagacagggcagatttatttctgtgagaagattgcaaaatataacagttcccattcttgaagtaactagagaaaatttttttagtgctttttaaaataaggtttatataatggtgcgtttcctgctgcatctctgccatcaatttcaaccaaactggtagaagttttgattgagaagtagctgtaagttgactttcagtgtttttacagcttagccttttccttagaagtcacttctagaaccagatccacctgatttaacaaaatgtgtttgaggttgaatcattgcaggctttattctgtctaaatgtttttttcttttctttttttttgtagtatttcgtagaactggagatcctgtttaggcagttgattccacagttttgactatcaagtaacccagttgtaatgtgggtgctacagcctcagcttcttaaatttggtttggagcatcctttcaaccttctttctccagctcttaataattacctgctccacttctttaatgactatttagtggtaaggtaaataggaatcttgtcttaagatgaattcatctcaaagtgatttggagccaaaaaccagaccatgacatttctggctgtggatttcgtttccaccaactcaccctcttgtcttttttttttttttttttgagacagtctcaccctgttgcccaggtctgataacagctcactgaagtctcgacttccctgggctcagtgattctcccacttcagccccccaagtatctgggactacaggagtgcaccatcatgcccagttaatttttatatagtttgtgtgtgtgtgtgtggggggggggtagataccaggtttgctatgttgcccaggctgatctttgcctgccttggcttccaaagtgctagcattataggtgtgagccaccgtgcctggctgggttcccccaactctcaaggggtgctgagttgactgattatgggaatgccagaacagaattctgagaatgcatttgtgtttttccttcttatcagactcattttaataatataacagatttaatttttagttttcattgactctttatccaactgatttaaaatttaaatatatttatgctttaatcactcataaacttggacctcaagttaaaaatttaatatccttagttccttagaattttgtaagaatttttgaattagaagtacaattttgtttagtttttacttacactaaaataggaaaatcattaagctgtttaaaaatagtggcaccagactgaactaaacaggagcagtggaaagtttcactttagaaactgctagagaactgaatccctagggtggtccctggatgtgatggtccaatctgtaaggtcatcttggaaatagatttagttctaagtttaggaccagaaaagactacttccttcctccaggcttttcacatttatccctaaagctatattgagtgagggcagatatatttttcaattccacaactgctggtgcaccacaacttgtaaggttctgtaatcttagtgctcatataatgccttacacatattaagtttttagtaaatatttgttgggggagaatgagtagatgaattggcatggtaagaactctaaactgagctctgggttataagtaatactgtttatataagtggaaatacgtgttttgtttattcatagattatagccagaaaactacacttaaaaataaattcctgaagtgaaagtaaaaattaatgttttcttctcatgaagtaagtgtggtgatacttacaagttattcaaatatttagagatgctcagtaaataactacttctgtggagggtgtcttagtcagtctgggctcctttaacaaagtgtcatagattggtggcttgtaaacaatagaaatgtatttctcagagttctggagactgggaagtccaagatcaaggcattggcaaataggcagtctggtgagggccttctttctgttcatagatggcactttctccctgctccccacatgttggaagggtcagggtggctttctgaggattattttattccattcatgtgtacttcaccctcaataccaaagtacctcccaaaggtctcctaataccatcactatgaggggtaggatttcatttcatgaattttgagggaacacaaatattcagtgtagagaaaacacctgaagtccaaaaatttatattaagaaaaagtcaggctgggtgcagtggctcatgcctgtaatcccagtttgtgggaggccaatgtgggaagatcgcttgaggccataagttctagaccatactgggtaacatagtgagacccccatctctacaaaataaaaacaacaaacaaacaaacaaacaaaaacaccaaagggccgggcgcggtggctcacgcctgtaatcctagtactttgggaggcctaggtgagcagatcacccaaggtcaggagttcaagaccagcctggccaacatggcaaaaccctgtctctactaaaaatataaaaattagccaggcatggtggtgggtgcctgtaatcaaagctactcgggaggctgaggcagtagaatcacttgagcccaggaagtggaggttgcagtgagctgagaatgtgccactgaactctggcctgggtaacaagagcgagactccatcttaaaaaaaaacaaaatgccaggcatggtggtgcatacctgtagtcccacctacatggaagactgaggcaagagaattgcttgagcccaggagtttgaggctacagtgagctatgatcacggtactacactccagcatgggcaacagagggagaccttgtctcttaagaaaaagaaaaagtcatacaagtataattcacacttggatctctatcgccatttggttaatattccagttgtgtattagacatttaataaacatgttctgtattcttgtagaggaagatgtgtgaggaggaatggaatctatcatacctatttaaggaatgaactgtatcatttcctctctaactgtggggcttagagccctaaaacctcatgtaaagataaatttgtggctgagaaagttaaaattttaaggggaaactaggttaggggaccttaaattgaaggtatgtgacagtttttgcatttgctagaagaaaacaaagcacactacagacaatctatgtgacattttatatatcttaaattagtaatactggaactgtcctgctcaacttcatttgccatccgttgtttgctagagactttctcagtgctcactcttacatgcttgtaaatctgtgctgctttgtgaagatgagagatgtatgaagtagtatttttctgaaccttcccctctatttaaatgctctgtgtctgtgcttttctgattcagagttgaccttatgggtcttgcttataaggtcctatatttcatagtgaaatatgattaggaggctgattaggatgattaagagaatgacagggtatttacttatgtttgcctcctatctgtttatcagttccccttcattctattcaggtttctgcagctgtgggtcctcccatggttatttcatgacaagccatttacccatgtctcggatgactgtctgccctctgaggatgcctgggtgtatttgctttcttcagtctccatttatctttcctaataattcactgcaaccatttctgccatctctctgccatcagctatacctcccttttctgtttctgacctcttttctcttcttaacgaattttccaaataagagtggctcatgatttgtaaaaagtagaactgaaattcatattgaaattcagatagagaaggtatacagaaatatattcacatatagttgaatttaatgtaagggatgtcaaggtagggaagtgattactatgtagatgttttctattgtgtttgtgattgcaaggaggattttatatgatagtcatagcttgtctttaaaagtttggtatgtgataatatcagaacagtaaaaggctatttcacattttaaaactaaatctttattaaataattatttcacaagttagtaattattgatattcttcttcagggactagagttcctatgcttcctaaactgacttttaaggaaagatgagactatattcagtgcagttttaatatgacatattttattatctcttattttttaaattgatattttatgaaggagtctatggactataatacgaaaattctggttggggaggcaggaaacctggctttcaagtacactccaatagcttttatataaaattcaggtgttctttttctctaatacttgaaatagctattttcattttcatgtcattttctgtacttttcctgatacttttaaacattgttttattttcaaatgaacagccctcaaagatgaaaataaaaagcaaaagtttcttaatgtcttaaatgcttttgtgtatattaagtgactttctttaaattgaatcttacttttccactgacatctatgatgatttctgaaatgtgctccggtgagtaaaatttgacaagccactccatctgccagtggcctgggtttttgttgttgttgttgttgttgtttttggtttgccttttgtaaaaaatgcttagagacaagtcaaccagtttgtttgctgatgaacagttattgcttcacccacctgtacaacttcattgtcctagctacaggggaaaatcatttatttttcacttgcgtcattctccagtcctgttgtcgtgtaaacttatcatgtgctccttgaagccatgcgagcaggcagagcagaatttcaggagaatgccttcagctagtcttctagttagtactacactgagtttactgcctgctttttagaacttccttgccaaaccttcactgaatgactcttcatataattgaatacagctgtagtttattttatttgccgaaaataattactggtgcccactaaaatggtgattaaaatccacttgatgtttgtactcttttttgctgagattttaaaaatgtgcttacagtgaggcttctataataaaaataatgtagtttcctgaattatggaattcgtgtgttctcatttaaggttgcagtttaaattgatcttttatcaaaatttagactgaagaagagattttccatctaatttatttacctatagaatttttaactttttagtatgaagtaccattttgtgagtgctctaatttcttatttattaaataaaaagaaaactaaattttattcattgtgtggatatagcacatacacataattttataaacatctttttgtaacctatattgaatcccagaggtcctgactcaggtttcagacaagctcaaaatacaggcacttacaacacaggtgctaacaacaatttgtcctaatcagttcagggccaaagttcagttccttcttctctggccaataggatgttttaattatgaaacgcagacatctcagcactttgggaagccgagactggcagatcgcttgagcccaggagtttgagatcagcctgggcaacgtggcgaaaccccgtttctacaaataatgcaaaattagccaggtaatgtggtggcgtgcccctgtagtcccagctatttgggaggctgaggtaggaggattgcttgagcctgggaggttgaggttgcagtgagccatgactgtgtcactgcagtgaagcctgggcgacagataacctgtctcttaacaaaggaaagaaagaaggaaggaagggaaggagggaagggaaggaaggaaagaaaagaaaagaaacatagacataccttagagcaacagttctcaaggagatactttgatggaatcccagacatcttccttttccaactaagtatctgtgtgtgaggctgtgttttctttattgtatttcaactaaacaacacatcatgatagtctgaatgcagaagagaaaggccaactgttttctgttgagctagaaattaaggatatttgtaaaattataaggctactctttttactacctttctttttgttttggaaaatatagtcatttttcatagaaacattcatgtaaatatgtaaaacagttaacttaataaatatatttaaaatttgttttgaagttttgatttctaatatgaaaaatattaacagatataactgacgtaagagtcctttgggtcctcagtaatttttgagagcataaagaggtcttggagatcacagagtttaacaactgctgccataaagaattgcttctgggccgggcgcggtggctcatgcctgtaatcccagcactttgggaagccgaggtgggcggatcacaaagtcaggagttcaagactagcctggccaatatggtgaaaccctgtctctactaaaatagaaaaaaaaaaaaaaaaaaaattagctgggcatggtcatgcacgtctgtagtcccagccattcagaaagctgagggtgagaatcacttgaacccagggggtggaggttgcagtgagctgagatcgcaccactgtactccagcctgggtgacagagcgagactccatctcaaaaaaaaaaaaaaaaaaaaaaaaaaagacttgcttctgtacttaaatgccagtttaacttatagattgtctttaatcacaaaagggtcatcaattgaaaaaaaacgatgtgttttatttgggtaaagtaaaataggcctagaagatgggcagattctaaacagtattcatcatctgaatgaaaagaagattctggataaactcagcatgcctttacagatacagaagaggaagggcgctgattgtgaaccatggtgcttcttggcatctgtaacacaggactactgacattctttctggcattgttattattctgaattgaagggagctcctgttctgacatgttgtaaaccagtctttgtttttgaactttttatgcaatgatgagaagagatctcaacttaggaatcttgttgacatgcatggaataggaagtggcatataaacttccaagatgattgtaacgaagttcgtatagttgatgcactgtgatttagttttgtcattaagattctgttttggaaaaatatctgacttataaaaaaatagaatcttaaaaatgtttaatcataataaccacctacattattagagtgctttggagtttaaaaagtaattttacatgttctaaaaatgtaagcacgataaaataactatgtaggtttaagttaatgtaattggtttgggtcactgctctgtacagcctgcacccagtgtttatattcagtgtgttattacaaaatgcttaatacatattgtatgtaatcatctggctctaagtactatgcttgtgtaatccattgttttcataatcatattagtatttctattatagggataatgaattagagttcaagatgaaacagtcgaacttatttataaacagagaactgaatgtttttaggatttttagggtagtgaaactactcttatgttaatatattggtgggtacatgtcattataaatttgtccaaactcatagaatataaaataaaaagactgaaccctaatgtaaaatatggactttggtgatagcgatgtgtcagtgtatgttcatcaattgtaataaacattcctttctggtggggaggttgtaaatgggggagggtgtgcatgtgtaggggcaggagttatatgggaattctctgtaccttctgttcaattttgctatgaacctaaaactgctctaaaaaataacctctgctttaaaaaggtatgtgtactctataatcttttattagaaatctttgttgctatttttacatggaaaaatacaggatgaagtcattattccctagaataaattatggaagtcaccattcaaagttatgatggagtcaggatgctacaaagaaagtagattatctcaatagtgttgtgtatgttgactgatttggggaagagagagtaattagtgaaaatatgtgaagtccatgttgagtcagaacaaaacggataatcaccttctgagatgaaaaaaatcatcaaaaagagtctaaaaattatctgttggtacagattttgggaaaatctagaagaggtggaagtagtgaggctgctcatgttatcaccctagtctgggtttgctggttagagcatgtatgattggaagagagagagagaagttcaggaaataccaacagagcatgggaactgtactaggttcagtgattccaaaaccaaaaatgaaacctatataacaatgctaacaatatatgtaatatttccagagtttccaaagcctcatttaaattgtgcctgaaaatgttagatatcattttttaaaattggaaaaaatgaggaatacaaaacttaagtaacccatccaaaggcacatactagtaggtaataatgaagataactaataataactcatttacataagaactctaagaacttagtactattatttctaactcacagatgggaaaacaaagtgtcgatgaggttgactaacttgcgtaagagtgcgtggttagtaagtgacagctgggattttaaactagattgtctgagtctgtgctcttaatccgtatgttctacatcctatctgttggttttgttattttttggatagagcatcttgacttacttagatttaaaataaaatccattgcagcacaaacatttgcaggggtggctaagatcctaacagaggcccagggagatgacagcaaatctttcctaatgccaggcttatattcttgtctcattcttgtctttgaagtcaaaacatttttagtcagtctctagaaacagaaacatgactgtgtcaggacactaattaattagcattgaggagttgttttctgattataaatatataactattgtactaccattccctggttggtaggattgctgtttgtgcacattatttgaggagatggaataaacaggcaaaatcagtttttacaaccctgtgtgaatactggtctgtacagcaaagattatattcattatggttataaactccttgtctgcctacaatattaatatggaatgaatgttatcaccaagttactgtaactcagaagacttcagaaaatatcctctaggtatcaaattaaatttgtaactacggtactttttgcttgccttgaatgactttccctggaagccagaagccttgtgttcagtttctagcaccatcagcaatgttaccttgggtaaatcatttaaacatgttgaacgtatgttccatttggcagtgggaatgccatatgctctcaaattgcttcagtgtgattttgtaaaagtgaaattgattttaaaatatgaatatataaagtgatttcactacttattaagtagaatgcattgtatacttcataaagctaacaaataataaaagactaaatgatattttggaatttaaaaaagacctctttagttttctgtgatccaaaatctggcttaattttgccttaaagctattcttagtgttaatatataatgctttttaaaaatcggccaaggtatctttgggcatttgtagtccttttctgttcagaaatgtcattaacttgaaatataaagatgctttctaaggaaactggtttgcctagccagatcttttaatgtagttattttgctatgtgagctgtaaaacccaaacattgaggctgctttccacaatgccttgttgcccagacagtgatgtcatgttttaagcatgtttagtttgcaaaggtcctgcttttgatcctttagttgtcacttttttaatgcggctcctcctgaatcacaaaggtactgaaagtaatttgcttcattaaggtctgttgctgacactgttgtatttcagtcgtcattcttctcttagcctccttcattaagaccttattcaaatttggatcatggttctgctgcgacatccacgccattatcatctaaatagcaattacatattcaaacacaacagcttctccttaactgtctgtaacttaacattttacatagattcaagtgggaattaagaataaaatgaatcttttcttcgtgatttacaaccctccctttcacccttggtttactagttaatgttgaataagctacttgtagacgaaggaagacaaaattattgattgctcagctttagttttgtagagagatatatattataaattgtttctgtattaaacagttacccaagtgtcagtgacccttattcaatcacccatgtatttattagacagcatttaccattttggatataaggggatcaggtctaacactctgttaagaaattaataggatcttttacaaaagcagcagtgctttataacttgaaacattgaaaggaaacctttaaaaataagtcaacatatttgtccttttgggacagacctcaaaaatagaagcaaattccattaaagtagtaatatacttttcctactacttcgttttggccatcttaaaattatattttataattagtaaataagctgatttgactgaaacgagcaactatgtttattggagacagacccagcttttcaacagatagaatgttaggactttttttgcccattaatatgtggtttaaagggaagttataacaagacaccaaatgcatatgtatatatacaaatacaggcagttgtatgtttttaagaagtttttaaccagcaaggggtgtgtgtttgtgtttgtgtgtctgtgtgtgtgtgagagagagagagggagagagagagaaagggagaggaagggagaaagtgtgggaggaaaagaggagaggaggagaagacagaagaggaaaacagtcctaactattaaaaataccaattaactacttaataacacatctttcagtgtcttgcataataatttcttagatattttgcaaaattcggcatggttaagggattttgtaatggttaaataattttattagttgtttgaaattgactgtctttgttttcctatctgtgtgctgagatttatctcaattatatgtgtgaataatgttatgcatggggttacttttaatatggatttaactgagattctagactatattctttgtaaatatgaacattagaaacttgttcaattgtgggtcgtcattaattcaagtcaggaaggctcaccctttgtcctcacaccatctcttaagaagataagtcctgtggataagctggagaggtcagatgttggtgttgacttaaagcattgccacccgaggagggcagaatgctgtaaaacaaagcagaaggaactgtgtggagagaaggtgaatgactgggggacttgaagttgaaagaaaagtcaggcgctgagcctgcaagggcaaaatgaggcttgtgggataagaatggtttgtcagaagtcacctgtttgctcagaagtcatctttccctaacaagggtctgtttggtatgttcctgtattacaatttataataactgtttttttacctgctgagggtaagatctttaaagtgacatcttaccagctattattcttagctcttgcttatgcaaatctcaatttgaaaaataaccttttaaagtttttttttttaaataatgagaacatattcagaatgacaatgtgatgaacacctgtgtacccaccaattggtttaagaaatataatttcttgttaaccttgaagttctctaagtcttctccttactcccacctcagaggtaaattccactctttaaattctgcttttttggggtctctttttaaatagtgttaacatatttttcatatgtgtagttttgtatgttttacaaccatatataaatcgagtcactcacaatgtatgtacaatatgttcttcagcaatttgcctctctcactcagtatcatgtatctggtctcatctatattgctctatgtatctttagttctttcatttttatttgacattccattgatgaatataccacaatttatatatctgttctgatgatgaacatttggggttttgttttgttttcctaaaaacagtgctgttactgaacattagtaggcagaagaaaaaacaaaacaccttgatctgtgtctcacactttatgcaaaaattgcccaaaatgaaaggactagtccctagaataagtacttgcaaaactcagcagtaaaaaacaaaaaacaaaaaaacataaaaccaaattagaaaatgggcaaaagacatgaagagacatttcactgaagaggatatacatatggcaaataagcacatgaataagtgtcattagccataatgcaaattaaaaccataatgataggtctctacaaacctgtatcagaatagctaaaataaatagtaataacaccaaatgctggtaaggatgaagagaatctggatcacttattgatgataggaatgtaaaatggtacaattactctggaaaatagacagtttctgaaaagctgaatatgcagttactatacgactcagcaattacactttgggcatttatcccagagaaattgaagacgtatatgtgcataaaactgagtatttatagcaattttattcataatagacccaaactggatacacaccaaatatccttcaacaggtgaatggttaaatctatggtatatctatatcatggaataatactcagcaagaagaagtaacaaactgttgatatatacaacaacctggatgaatctccagagaattatgctgagtgaaaagagccaatccctaaaggtaacgtactgtatgacttcatttatgtagcattcttgaaatgaccaaactgtacacaaaaaatagagaaatcattggtcgccggtgggtaaggatggggtgaaagttagaggcaagtgtgtgtggctatagaaggataacactggggattctggtggttatggagatgttctgtatctggtctgtgtgaatgaaatatcctggttgtggtattgaactatagttttgcaagatgttgccattgtggtaaaccaggtagaagctacatgggatatttccatataatttctccaatctgcctgtgaatctagaattatctgaaaaagttcaattaaaagacaacatgatgctgttacaaacatccttgtacatgtctcctggtgcacatatgtgagctttcctctagattttatttccgggaggaattacaggctatgcacatgttaactttagtaaatcatggcaaatttttttcccaagtggtatatgaaaattctatccttttcatattatactctatcctttttaaggatattgtacttcaaggatattatactctatcctttttaacatgtaatactgtgagacttaaatttttatcagtctgttggttagaaaatggtatcttgtgtttttaatttacattttcttgtttataatggaattggacatttttatttatgtttaatagtcatatgtggtttttttgctcagtaaaatcactattgatctcttttccctgctgtattgtctgtcatttaaaaagttgattctaaggggatctagttacaaattttgttgcattttaatgacttatgtttttctttttatctgttaatgaagagacattttgatgtgacagttttaaaatatataaaacttttccttaactttcatatttcagtctgatttaaaaagtcccttcttggagatcagaaagtcatcttcctatagcatcttcttatagctctatggttaactttggttatagtgtggtatagcgatccgattttaatttttttttgtagggataacctattttcttagtactattttggattaattcatcttcttttcttcacgtatcttccaagcttactcttacatatatagtatctttggttctcctactttatgaggctatttttctctctcttagccaatgtcataaagctcattatattaccatcctttaaaaccatctcaaccttcctttgttctctgcttttctatataatgaagcatcagttgatcttatgccaaataaataaaaaatgaataacagatggataatcactcaaacctacccactctgatgtgatttttgttgaaattttattgaacatatagattaatttaggggagaattgctatatttacaatatttagtcttcttcagaaatatatttctgtccatttgcttaggtttccttaatacatttttgtaaaattgccatgcatttttcataaaaatcacatttctgcttttgtcagatttattcttagagtgcttttttgttttattattatagtaaatatttttaaagttgtattttctgtttgttgccagcatagaaacatgtagctgatacttgtagcaaccatcttgataaaatatttacttcccataattcatctttagattcttttgaattttctaagtacgtaattataacctctgtgaatagtgagttttgtttcattcaaatccttgtggtttcattttatcttttggtcttactgcatggtctaggacctctagtatgttgaagagaagtgtcaaagaaaacatcttttccccacttttgattgtaaaaagaatgcttataatgtttgcaattgtgaactactacatacaatacattttgtttttttgggttgctcctggttggctaaaggcttattgtagaaacataataggcatagagtgttgttagaattggtataagatttgattttaatagaattcacctgtaaaaattatcttggcctcgtgtttctttagtgggtagcttttatgtaccgaatgaatttgttgataattgcagactagcctattgtgtcaatttggtaagatatttttctaggtgattgctcattcaaaaaatattctagggccgcgcgcggtggctcacacctataatcccagcacattgggaggctaaggcaggcagatcacaaggtcaggagattgagaccagcctgaccaacatggtgaaaccctgtttctactaaaaatacaaaaaaaaaaaattagctgggcatggtggcgtgcacctgtagtcccagctactcaggaggctgaggcaggagaatcacttgaacccaggaggcggaggttgtggtgagctgagattgcgccactgcactccagcctgggtgacagagtgagactccatctcaaaacaaaacaaaacaaaaacaaacaaacaaacaaatctaagtttatagacagagttttttttttttttaaatgatatcttcttaccattttttaatctctgggattttcattatgttctgctcctcccccccatggcaatattgtttatttattgctttactatttattttcttagtgttttcaaaagaccagttttaggatgtattgttcctcttttgcattttattttctgtttcatcatttcttgctcttaccttaattatttcctttttcattttctttggagtttattttgttagtttcattttgactttttaagttggttgtttgtccttggatcatcatttttaagcttttaaaaattctaatatgttcattaataatgccctgtatttccctttaaatgctattgagcagcttccaaattttaatttgtattatttccattcgtttgtcattttgcacatttttctcttttcaaaaaattaaaaaaattttttctagaggcagggtctcactctgtcacccaggctggagtgcagtggtgtgaccacagacagctcactgcagcctcgacctcctagtctcaagtgatcttcctgccttggcctcctgagtagctgggactacaggcatgtgccaccacacctgccccacacgtttttcatcgtcaatacttctttgttgagttatttttaaatgttttaagatttccaaaaattgagtttttttgtgtgttatctttttgatgaagatttttaatttaatgtcctgtggtcagagagggtggtacaaatgatagaaattcctgaaatgtgttgagacttgattcatggccttttctcaaagaaaagcatatcagtcttaactgacctccacttatatgactttgcatattgaccagcatttccaacttttctataaatccttggatgttgacagcatctagtttattctctgatgagcagactttctttggctgctccagcagagtgctgctgaagtgtcaagctgtttgctcctaaatgtatgtacttgtttattataattgcatgatttaattaaaatatgaattaagaggttgtacttaaacatgaataaagagggagtacttatagctacgaaactttgttaaatgctttagaaataatctatatagtttaattgctaaaataaaaaaggagctgtcaatttaggtgtgggtgagatgacttaggatctaggaatcagtggtagattgatttgtaaatatctttaaattctcatttgctttaaaacagttggaggttgtgtacaatgtattatatgttggacttacataagaaagacttagaactccatcaggtgtccctaactgcaaataaaggcctcagctgaaaaccttcctgggggaaggttaaagcaagtaacaggttggaagctgggagaaagtcaggatttagggtgttgggcacttgtgtagagtaatttttttatttcctcatgaactggttgttcaaaaatttttctttttttttttttttttttagttgatagtaacacttgcagacctgttgtaccatgtggttgaactaagcagaacaggggcactagaattaaacaacaacaacaacaacaacaaaaaactacagaggaattacagttgccataggcagcaatgaaactagaactaaccaactgcagttttttgttgtaggcaaatccacaaatcttagaacttaaaaaaaatacttttttttagtgttttacgagatgaactctgaattatagaatatctcaccattaatatgcaccttcagcatagaaacagttaaagaaaataaacttacctgaaactattgtattccctgtgcattgtcttcacatcctttttctgagtacctgagacaaagtgaactacaagtaggataagaactgaaaagttttcaccagatttatgaatacagtttcatcaatgatcttggtgaatagtagtagcagaagagttgaccatagaccttatagctagctgttagaatagctaatttaatgaattttttcccaaatctgaaactcaaagctactgataaccaaagctagttccctgataagtaacttagggaagtgcactcttatttcaataattaatgcttccatgaaattatataaacattcatgcattccgacaatatctgaatatttctgtgtgctaggtgctgtgctgggtgttgggtatgccattatgaacaatacaaagaagagctctgttttcattcaaatgaggataaagtttttcaatagcaattatttttaaaaatgaaaataaagatccacaaatttccagaaaaaaatgacctaaaagtcatagttttaccattgaatgtaatatccttcctgtaatccatgaatcagagtatgtaaagagatgtaaaagatgtaagaaagagttttgagttttaatttgggaaaagaagtataagacagtagtagcagtcatataaaatagaatagcatcaaacatttaaaaaatagtatcgtgatagcatagagcaaaatttacattttaaccatttactaaactttggtgaaaactatcacttaaaaaatccttaattacaaggagatagtataaaacatagtttgttgctgttgtatatttgtttttaagtatctcagacaaatcgaataattttttaaattagaaactaatatatgtcaggcatatggctacagttaaaattttttttgaaaatgaaattatggatgcagaaagcaaacaagctgtggcagaaaaggatggatctaaatatgaagaggaggaggagataagagcaatccagctgcaaaaattactcatgccataggtagttttagatgccctagaaatagttctatgttgtattgaataacagcttgaatcaggattcgatattattacaacatgggaaggaacaatgccaagaaaaattgtatttattcttataacttcaaagtgatacaggagctcgaaagaaatttaggcagttagtgaggctaagagagtccttggcaaggtttccttttaaataaaaagcagcccccaaatcatttcttttctaacaaaagagcagcctgaaagatcgagctgcagacatagataagcaagctggaagcttgcacaggtgaatgctggtagctgtgccaatagtaaagggccacttggaagccaggtatgttcaacatggaggctccaccttcccttttctttgtcaccacgtgcacagtaaagaggcaggcaacatggtgctggccaggtagcaaacccatctgcctagtaaaagattagggtggaggccggcgcggccggcgcggtggctcacgcctgtcatcccagcactttgggaggccgaggcaggcggatcacgaggtcaggagatcgagaccatcctggctaacacggtgaaaccccgtctctactaaaagcacaaaaaaattaggcgggcatggtggcgggcgcccataatcccagctactcgggagcctgaggcaggagaatggcgtgaacctgggaggcggagcatgctatgtaaatggcacacctggtctgatcaatctctcgtgccctatgtaaatcagacaccgcctcctataaaaccaacctcttcttgccctgaacccggaaacccgttcgggaccccttcctctgcacgagggagctttcctctttctttttcctttttctttctttctttttttcttttttttttttttgagacggagtcttggtctgttgcccaggctggagtgcaatggcatgatcttggctcactgcaacctccgtctcccgggttcaagcgattctctcacctctgcctcccgcgtagctgggactaccggtatgcgccaccacgcccagctaattttcgtatttttggtagagactgggtttcaccacgttggcctggctggtctcgaactcctgaccccaagtgatccgcctgcctcagcatcccaaagtgctggaattacaggcataagccacctcgcccagcctcctgtttctttcatctattaaaactccactcttaaactcactccttgtgtgtcctcgtccttcagtttctttggcgtgagacgataacctcaggtatttacctcagacaactctgctacttcagaagtatttactttattaaatgaatatgatttattgttttgaagtaaaatgtttaaggtatgcatgtattttttatgatttcccactttaactgatttttttattaaatgaagaaatggtctcaatcacattggctaacatggcctctatttatttaattcatctgtttttcccactttggggcatcaacagcatggagtatttggaaaactacttgtatttgtaaagagtaaaatgcagtttaacaaagaagttagtttgtcattgtatagttcaggaactctggcctggatgagagcatgagtttgaaattttgtcctcaagattttgtttttatcttaccatcaccttttatgcttaagtttatgattggccataattatcaaattgacacattatgtcatgtgaaaatctgtttaccaaacttttctattaataaacttgatgtttaattgtaatattaagagtcacagagtgctgtagattctgtttgtcatagttgtgtagcttttagagtttagggaaatctagtttttagaattgacacaatgatttttaattttagcagtgtgttgaataacctgtgatataccattcacttattaacttcacattgttgtataataagttataaattttagatcagataagaaagtaaaactggtattaatttgggaagaagaaattgcagaacttgagtgatttttccaaataatgtgtcagctgtaacttgaatgtgttatttttatccccaagggtattttgaaatatacttatgtgaatttcttatagtttattttaaccataaaactattttgatatttttataatgccatcgatgatactgtatgcatagtgagggcatgggttgtctgttcttaccaccatattcccagcactagcatggaacaaatgaataagaacggagtaaaaatgcataatctaaacttgactatgtgtgtcttcaaaataatacctttaagttattttgaaggaaaaaactatgtatccaacaaattcaaacagatacttacaaaattaagacgattgtaaatgtgtgttgtcctccttctcattgtttttcacatccaaaaatgtcctcttggagcctcttatctgagtagcttctgtggatctgatgatgctaggattttattttttcttttattttaaagttcttctgattacatcatctctttgtatagacatcattcttgacagatggcatttattaaatatggacagtagcaggcagttaaaaagacctgcatgagataggcaggaacctttcttttttctttctgactctcagaagcaataccagcattagctttatttaacttctagattaatttaaaaagaaacctctttaaattatgactcaacaggtacagggtgaagtgggggaaatgtatgtgtgttttaaagcttcccaagtgattttgaccatcagttaagtttagaaaccactgattacaattaatttccttagaatttgctcatatatttaattccaaagaggaagaaaattgaaattttaaaaaacatatgagtatttttggagatgacataactttccttttattgtgttaaaaaaagctttaagaactgtttttttctgcatttttattaattatcaagatttagtgatggtttagagagctaaaaacacctttagggtgaattcagaagatctagcagatacaatgatgaaatatgatcagcaagctttaggagaggataacaaatgtgtgattttgaaatctcttctatttgaaaccaatccagagtcttgaatttgatccagtatatagtatgctacaaatggaaagattaaactggagcaatataattagggtaagccattgcatctgcacttgtatcgcagcaactgaatttgaaaccagctgcaaaatggtgactaatctctctggcaagcccacatgagagtgtagtacaataagccagcttcagcctcatgagcacatgtttcttcaacttgcctctgagcaggtgatggtgatgatgcaatctgattatacttttgaatgtattctaaccacagtcaacagtagagtctcacaagggatttcacaaaagacttcaaaccgactgtatatttttcagagagttgagctatagacagccatggaaagtagtagttttttttttcacgttagtgactactgtactttgcagtactttataatcttaagtttaggaggctttagttttcatatgtgaactgaagatgagaagaataatgtggaaagaaagtacttgtacttggagcttttattctgaattgttcacaacaacttacactgatcaattaaaataattaaattgtctagactatttaattctgtacaaacaagagatggtaaatcagtgtactgtgtttaagtggtacactaacctttccatattcagagaagtacctccctgggtcttgaacattaaaggtgtttaataagtactcagtttgacttggacttgagcctttatttttgaagggaataaagtttcttcttccagtgtacctcagagggacttggtaagcatgaataaagccatctgtttgaaaatgtatgtcatttttggaaaagtgctacagaacctaaaatacagtcacaagtattatttcaaatgtatagttcagaagtagaatacttagaaattgcttgttaatcttaattgtaaatagctaaaaaaaatatagcttgcaataaaggacacaagagcattaaaatataaaagtcacaaactatacatctctgagaataaagggggaaatgggatgtaaaaaccctaggctggtggcactcacagttggtatacagcagaatgactttggctgcttgtcagaagcgaataaccctgggcctcttccccatcacttctgattttataggtttggagtgtgtcccaggcatctgtgtttttaatcatttccccccctaacttactctccccatctaaacttgagaaacacccagactactgtagtattatggtactatagactactgagtattagtacagtactatagtgctgactagtaagcttcctaattgccaaacaaaagaaaaattttcactgtcatcaaaagaaataaactttcttcatggtaattataaaaagactttttgagaaaaaaaagcatcttcaatagtgattttgtagaagaagccaatttgtttttttgtgtatttttatttaaacatttttattaaaacaaggggcattttactgaagaattaagagccttcagtgaaggctaagtgcaggtgtgctgccttctagtaatccagactaggtggttagtatgagttatgggttgaattctgtccccccaaaaaggtatatttaagacttcacccccagtacctatgaatgtgaccttattttgaaatataatctgtttgcagatggaatcaagttaagatgaggtcatactcattggagtgggccctcctccttcactgactgatgtccttataagaagagggaaatttggacacagggagacacagaggagaaatggccatgtgagagaggcagagatcgaaatgatgccaccacaagccaagggacaccaaggattgcaagaaaccaccagagctaggaagaggcaaggaaggattctgccctagagacttcagagagagcttagccctactgacaacttgattgacgatttctagtctccagaaatgtgacagaataaatttctgttgtgttaagccaccacgtttgtaccattttgctatggcagctttaggaaactaatacagtatgtgaatctctttttctgtcatttggatttttgacaagtttcttttctcacatattccatatgtgtgcagaggttcatgagctctggacctgtcattgtggtcaaatttgaattctactttaaatgttaaggcacctgcgtgaaaaccacactactgctgcataattgtgagccgtaggggatactgccattaggagccatttttccttaaaaggaagctcatgcatttgaataagtagtaaatggtgatggcagagttatgtttcataaaatatggaggagacttttgtcatcagcaggaactgtcacttttatgatcttctactggaatgaaaactcacttccaccccaggaaagatctctgcagaggcagtgaatcaatctctgtgctgcctcttcctcctccttgatcttttttgtgattgtccatgaggattttgctacctgccctctcagggattttactgaactccccatctgtgatggttaatactgagtgtcaacttgattggattgaaggatgcaaagtattgatcctgggtgtgtctgtgtgggtgttttcaaaggagattaatatttgagtcagtgggttgggaaaggcagacccacccttaatctggatgggcactatctaatcagctgcccgcttggctgggatataaagcaggcaggaaaacgtgaaaaggctagactggcttagcctcctagcctacatcttttcccatgctggatgcttcctgtccttgaacattggactgtaagttcttcggctttgggacttggactggcttccttgctcctcagcctgcagacggcctattgtgggtcttgtgatcatgtgagtttaatactccttaataaactctctctctctctctatatatatatatgtatatatatgtatatctatatatctatatagatatatagatatatactattagttctgtccctccagtgaaccctgactaatatagattttggtacgaggagtggttctagaggaacagaatattaaggatggagttccttcgttggttttggggattctggagttggctgcttaatatgattagacccaataatgcgaaggactctacttctaatggtatagagaacactgatagtccttggcatgaactgtttagacagttatgcaaaataaatgcatttgacactcctgatttaccgcccatgtgagacaaggggtttagtgactctgtacataataccttaggctgtatgtggagaactaaggaatgtaatgaagttggttggttgctcctaagttcactggacaaagtgatgaaggaaaatgatgaattcagggattctgactcctggctacagaagcatatactgagccttaaatctcctaagactgccctcagtgagagtcttacctcctgtagagaaagagctgaaattgtggcaaaacagacacaagctcttatcatgtgggtggctgacctgtaatggaaggtgcatgcacagcctcaccaggtgtctactgttaaagtgaaggcattgattggaaaagaatgggaccctgcaacttggaatggggacgtgtgggaggaccctgatgaagctggggacactgagcttgtaaaccctgatcaatcttttttgccagaagaaacagcttctccatccccagtattggcaacattccctctccaaccgatgctgccatcagcctttccacctttgtctgaggagataaaccctgcactgcctgaggcaacagtgatggcctcccctgagcagttgccaggcaagataatgttgattctcctcaggagccactgccaacatccctgtttgcttctagagctataactagactaaagtcctggtgggcccctagaggcaaggttcagagtgtgacccatgaggaggtgtgctacacttgagaagaactgcttaaatttttcagtttacataagcagaaatctggagaacaggcgtgggaattgatattaagggtgtgggataatggtggaaggaacatagagttagatcaagctgaatttattgatttgggcccactaagtagggattctgcatttaatgttacagctcagggagttaaaaaatgttctaatgtagtttatttgcttgattagctgaaatgtggattaaaatatggcccactatgagcgagctggaaatgcctaatctcccttggtttaatgtagaggaagggatccaaaggcttagggagattgggatggtggagtggattagtcactttagacctactcttcccagctgggagggtccagaagatatacttttgaccagtgctttgcaaaatagatttgtgagggcagcacctgtatctttcaagagcccgataattgctcttctctgtatgtcagaactaacagtggcaaccatagtcactcaactacaaaatttaaatatgatgggaataactggatcctgaggtggcaggggccaagtggtggcactcagccgtcaaaggcaaggtaggcatagctactgtaatggacagcagaggcaaagcaacaatcagaatagtctgactcgtgtagagctctgccattggctaattaatcacggtgttcctagaagtgaaattgataggaagcctactgcatacctacttaatttatatgagaagaaaattttcagatcgaatggacaaaagactaatttgaattataaaaacagaatcatggctcctcaatcaatttccagaattgagccagtttacagacccagaaccccttgaatgaaggggaggccgggtccccttgaggaaggatcccattatactaccgacaatttatgctgttaatctttctcccatcctcccccaaggagacctccagccttttatcagggtaactgataatgtcatttcagatagtccctgaaatgcctcatcatttccctttctccaatgcacggttgatctgaggtgatgttgattccgggggacccaatgtggtcttccagttaaaatagggccttatggaggtcaggtaattaatggagttttagctcaagtctgacttacagtgtgtccagtgggtccccagactcatcctgtggtcatttccccagggccagaatgcataattggcatagacacacttagtagctggcagaacccccacattggctccctgacagtagggtgagggctattatggtgggaaatggaagctattagagatgcctctacctagaaaaatagtaaatcaaaaacagtatcacatccctggaaggattgcagggagtagtgccaccattaaggacttgaaagatgcaggggtggtgattcccaccacatccccactcagctctcctgtttggcctatgcagaaggcagatggatcttggagaatgacagtggattattgtaagcttaaccaagtggtgactgcaattgcagctgctataccagatgtggtttcattgcttgagcaaattaatacatctcctgatacctggtatgcagccattgacttggcaaatgcccttttctccattcctgtccataaggtccaccagaagcaatttgctttcagcttcctgttctacctcaggggtatatcaactctctggctttgtgtcataatgttatttggagagaacttgattgcttttcacttccacgagataccacactggtccattacattgatgacattatgctgattggatccagtgtgcaagaagtagaaaacaaactggacttactggtgagacatttgcatgccagagaatggaaaaaaatctgactaaaattcaggaaccttccacctcagtaaaatttctaggcgtccagtggtgtggggcctgttgagatattccttctaaggtgaaggataaattgctgcatttggctcctcctacaaccaaggaagaggtacaacacatggtgggcctgtttggattttggaggcagcacattcctcatttgggtgttttacaccagcccatttatcgagtgatccgaaaggctgccagtttgagtggggtccagaacaggagaaggctctgcaacaggtccaggctgctgtgtaagctgctttgccacttgggccatatgacccagcagatccaattgtgcttaatgtatcggtggcagatagggatgctatttggagcctttggcaggcccccataagtgaatcacagtggaggcctctaagattttggagcaaggccatgccatcttttgcagataactactctccttttgagagacagctcttggcctgttactgggctttggtggaaactgaacgtttgactatggatcatcaagtcaccatatgacctgaactgcctatcatgaactgggtgctttctgacccatctagccataaagtgggtcatgcacagcagcattccatcatcaaatggaagtggtatatatgtgatcgggcttgagcaggtgaaggcacaagttacatgaggaagtggctcaaatgcccatggtctccactcctgccaccctgccttctcttccccagactgcaccaatggccttttggggagttccctatgatcagttgacgtaggaagagaagactagggtctggttcacagatggttctgcatgatatgcaggcaccacctgaaagtggacagctgcagtactacagcctcttcttaggacatccctgaaggacagtggtgaagggaaatcttcccaatgggcagaactttgagcattgcacctggttgtgcactttgcatggaaggagagatggccaaatgtatgattatgtactgattcatgggctgtagccagtggtttggctggatggtcagggacttggaagaagcatgattggaaaattggtgacaaagaaaattggggaagagatatgtggatggacctgtctggtcaaaaactgtgaagatatttgtatcccatgtgagtgctcactaacgggtgacctcagcaatgcttctgccaagactatcatccatggactcatggaataccttatccaccatcatggtattccacacagcattgcctctgaccaaggcactcactttacagctaaagaagtgcagcagtgagctcatgctcatggaattcactggtcttaccatgttccccatcatcctgaagtagctggattgatagaataatggaatggccttttgaaggcataattacaacgccaattaggtgacaacactttacagggctgacgcaaagttctccagaaggccgtgtatgctctgaatcagtgtccaatatatggtactgtttctcccatagccaggattcacaggtccaggaatcaaggggtggaagtggaaatggcaccattcaccctcacccctagtgacccactagcaaaattttgcttccttttcctgtgacattacgttctgctggcctagagctgttagttccagatagagatgttagttccagagggagaaatgctgccaggagacacaacaacgattccattaaactggaagttaagattgccagctgtaccctttgggcacctcccacctttaagtcaacagtctaaggagggagatacagtgttggctggggtgattgacctggactatcaagatgaaatcagcctaatacttcacaacagagataaggaagagtatgcatggaatagaggagatccatagggtgtctgttagtattaccctgccctgtggttcaggtcagcgggaaactacaacagcccactccaggcaggactacaaatggccaagacccttcaataatgaaagtttgggtcactccatctggaaaaaaacccatgacctgttgaggtgtgtgctgaaggcaaagggaatacagaatgggtaggataaaaaggtagtcatcaataccagctacaaccacatgaccagttgcagaaatgaggactgtaattctcaatgagtatttcttcctctttttgttaaaaacatgcttgttcatgtatacactgtgttaagaaaatgccttcattttcctttttactttatcatgagacataagatttattggcttcatatcaacccttaagtattgttaactttatgtaatagcatttgggttggggattggtgtgttttcggttgtacatagcatagttgaattatgttaggcataattatgaccttattattgtctttatttgaaaattatatatgatctcaggaaatgtgtatgagttcaagttgacaaggagtggatttgggatggttgatactgagtgtcaacttgattggattgaagcatgcagagtaataatcctgggtgtgtctgtgagcatgtttccaaaggagaataacatttgagtcagtgggctgggaaaggcagacccacccttaatctgggtgaacaccctctaatcaactgtttgcttggccaggatataaagcaggcaggaaaacgtgaaaaggctagacaggcttagcctcccagcctacatctttctcccgtgctggatgcttcctgtcctcaaacatcagacttcaagttcttcagctttgggacttgaactggcttccttgctcctcagtttgtagatggcttattgtgggacctttgtgtgagtttaatactccttaataaactctctttatatatgattgtgtgatttaatgctccttaataaactttttttatatacgattgtgtgatttaatactccttaataaactctttatatatatatatctattccattagttttgtccctctagagaaccctgactaatacaccatccaaacctattttcttctgttggccctatttttaactcttgggacctccattctgtggtaaaatgccccattcagagtaccagcttgaagccaaactggtacatgttcagatatgtgtgtacatgtgtgcacatctagagttgcttttttgaggataatttggctttaactgtaggaatctttatagtcaacttgacataaagatctagggtacctctacctgggaaaatcctggttctcgctgttcacagctggcggccagcaggcaagtgatttaatctctttgagtgttcagttttctcatttacaaaattgagatgataaaacctatctcaggccgggcacagtggctcacacctgtaatcccagcactttgggaggccaaggtgggcggatcatgaggtcaggaggttgagaccagcctgaccaacatggtgaaaccccgtctctgctaaaaatacaaaaatcagccaggcgtggtggcgtgcacctgtagtccgagctactcaggaggctaaggcaggagaatcacttgaacccgggaggcggaggttgcagtgagatgagatcacaccagtgcactccagactgggtgacagagtgagactccatcttaagaaaaaaaaaaaaaacacctatctcagaggttgatccatggattaaataagtagccatatctgctacacaggaagcactcaagaagtggtatctcttgctgctatatgaatagtattaagattccagtagtcttttcactatgttccttctcatttgtggtgtatccatgttttcattcatttattcaacaatatttatagtgggcctaccgtatgtcagtgactttgctgggcattaggaatgtatggtgaatatgatggatacagcctgtgccctcatagaactgacagtccagttgtagagacagacattacatatacgacaacctaaataagtgtaaaactacaatgttcataagtggtatgagagcagctgaccaaatgtggaagattgagtaaggcttccataagtacataatgtatttgtgtcggaaatggaaacgtgaatgagttaactggatggagaagggagaggtgagtttgagactgagggaacagcaatgtttaatggctgtttggtgggagggaacatagcacatttggtgagtgggaaaaggcccttccactgatgtgcagagagccaggatggagcatggaacatgatgaggctcgggagttaggcagaccctggtcatgctagaccttgtaggcactggctgtgtcttcatcttaagagccatggaagccaatgttgaacattaagctgaagatgggaatgagctggacaattatgggtttgaaatgatgtttcgttttcatcctttgagaggactttgttctctcagacagatgctctccattctgtcacacacgtggtacttggcttctgtgattagggtgccagtctcttgcagtcattctgccacttcaggctatttctttgctacctcattgataaggctgccatcttctgagcttgcatttgcccattgttatcctctactcactctggattgttccccagacttcatagagccctttgacttgatttctttcccttcctagatcctatagttagcctggacaactctaaaattcaggatgccctggtgaacacgctaacctcagtctccaaagactttgtcagtggagccagccattctcttttctaccccagtcattctctgctgtggtcttgctccagattatataatcacacagagcagtgctaccttgaaaaacgtaaattttaaacccagaaatcctaccctctcgtgtcaagttgtccctctttcctgccactattcccactcgttcactgaattcattgacagctgtttgctcagtctctcatcactgtctgacttctctcacccagtctggagcctatggtcaatagttgcagtgttctaagatcaggtctctattatttaggaccctgccacttttcaactctggataaactcgacttttccctttttctgcccttgctcctacactattaagcattcctggaaaaaatcacaactgtcatatgggcacgataatgtatctttgctttccagttatgtgagctgtcagctctcttctgtggtcttttctcatcacttttgtcttaactgggtgaatttcaaccttggctgtactttggaatcacgtggggtgctctaaaaaataccaatgtctgcgatttactcctagagattttgatgtaattggcctgaagaacacctggcagggacgttttagacactccccaggtgattctaacatgcagctaagatggagaaccacgtgctaatgtgcccacagagactgatggacatgtttgctgcttcttgcactctctgctagtcctcattttaagcaattgatcttgtctcatccagttctcgtcctttttctacctttaaacttacctctgattgcattcatacttgcctagttcattcttaatctagagaaaaacaattgcctacatcctcacgtataagcccttcaaaaggtacactaggtgtctgtctcaccctctctgctcctgatctgagccagatgagcttagtggctaggtttaaataataggcatgtactaataagcatgcatttctcttaaaaacaaaacaaaacaaaaacctgggggaaaaaaaaccctcaaaatctgccaaacctaaatctaagcaatattaagcagaaagatgacaattttcaaagcaaataatatttgatgaaatatactgagatatgtggtatttaatagatggttggggctggataggggcagtagtcggagtggaagcagtggcgggaatggtggtggggctttgtatattacactaaagttgttgaactttgagttttaaatgtgttgaaagttcctcctgggggaaaggagtaaaatgatcaagtatgttttttgtttgtttgtttgtttgacatggtgtcttgctctgtcaccaggctggagtgcagtggcaccaatctcggctcattgcaacctccgcctcccgggttccagcaattctcctgcctcagcctcctgagtagctaggactacaagtgcgtgccaccacgcccagctaatttttgtattttcagtagagaggggggggttccaccatgttggccaggatggttttgatctcttgacctcgtgatccacctgcctaggcctcccaaagtgctgggattacagccgtcagccactgcacccggcctcaaatatgtgttttaaggatggaactattgtagtagtgcagggcatggtctgtaaaggaaacaggttagaggacatttggaagcagtgttcagcggtttaagcaagaaatgatgatgtcctggactaaagtgatagcagtgaggaagaaaaaggaaaaggaaaaggaaaagcaaacaaacaacccccccccaaaaaaaaaacacttctagaggtattgttaaaactagaatcaataagattggctcattttgcattctggagaattatgccaaagactcataggcatttaagttaattcgcttatggtaattaacccaaaagactgctaaattgcctatttgtttataagctgccgcaataaaagagagttttcagaaaaattttttttaaagaatagaaatctcttctatggagtgtaacgctagagcaaatttgaaataagctgtttgatcagtgactcagaatctttataatgatccattaaaatgtgtaaaagaagccttaagtataaaaataccataatcaggagaagtgtagtagctaagggcttggactgtggacacagactggctttgaagtttatttcctgccttaactgacctgatgaccttgagcaaattgtttaacagtgctatgattcattttccttatctgtacaatggagacagtaagagggtccaccttagaggattgtgaaaaatatctgagataaatattaatgaccattattttgttttatatagtcaattttagatagatattcttacatcttctgcttggattacttgctctagccattgagattcactaaattattcttgttatttagtaagcaaatgcaatgagtaattcctgttccttttaagaaaatattcattggctgaatattagccaactgatatgtttttgttaaacgtaaaagagtagatcctcccatgaagttccagttgagtgttttttcttgaaatttactaattgtccttaacttctataatcaataaattctgtgaagtgaaagaagtagggagaacagtaaggtgaaaaggcaaacattttctaatgagttgctattagtcttctaacctgggataaataataaagtttctaatagatgtgtataacatcatagccatttggggtgttttaaaaatttccatgttaactttaaaccttaatctttgttgtatttatgacagaaaaaaattaaaaatgacttaaatcagtgtgcctaagactttaacattgcagtttaaatttatagacttcaacataaccaccagtttttggtgatccaacattcagtctgattttccacctcattgaaaacattctacagctgctgccgagtgatttcataaattgcattcatgatcctggctggaagttctcttaaagaatgtggtctggatgaatacacaacagttttaacacagtcccataaaatatagttcagtgggataggtcaagtttaaagttgcacaaggatttcataaacaccctgagtagatgggcactaaaactttgaatgtgttatatggaaaaaccttataaagggtggcagtgttccaaaggtagattaagttggtcatctatgaaacaattcctactactgatggttcttaatagtaccacctgctagttgtttcatattaaattgtgtgaaacaacacattctggaaactgatgaactacttatttatttaataaacccgtcaatgaaagaaacctctgtcataagtaatggagttatttattaggcccaaaaagtcttaagccagaaatgtcaggcatttttgtggacaaagagtgttgtaatctcgtattgttttttcaaacagcagcaagtagcacacgatacccagttggtatgtttgtcctttatttggatggaaactccagaatctctgggtagtcagctgaatgccaatttaaacctcagaaagacatcagtggtcttggtgtatagtttcaaagataccactaggctttaagtatgccctgaagcctgacattttgggtgcttcactgatgcatttcctttgctgatcttatttattggtttagtgagaatatcttcaatgacatgacagttgctatcttagaaagcaaggccaaacaatctaaacttcatattcctgattgaaggaattcctcctgcaattccgtacattataattgtggtcccttgttagaatagatgttgctcatgttttgaattaatatgatgacatgaaatgagtgatacacagaaaacattagcaatatatggtagttatgactttgccatctagtatgtcaccagacattgtacagaattatcccaggccagtttttaatactagccagtcatgtcaattgaagttagatattctcccaaaatattattttcagctctgtcactaaacttttctttatttataataatatatgactttttatagttgtgcgttgtatgggtctaaaatagtccatttgtattagtagctttgagctatcttgaatctagatagcatacaccaagacagatttcccacatatttttaaaattgattatagacttctgtcacacataatatgaacatctctctttagagaagaaaatatgagtgtaatttcaggttctttcagataatcatgagattttaatttccttggattttcaaaggaatgtaatctcttttcatttttttgttataaatagttaaggattaacagtgtgtgctttaattacaaggtatgtataaggttattctcccccccgcaaccaaccctttttttaaacttttgatgtttttgatcaatgtcattattatcaaagttctttcagagttactgcagggctataggcttaagttctttttgagatattgttcctagttttgtaatcgtaggagactttgttagctcatgacatctcagagctttgagccccctgtggtatgattttgggtgtgccaggtcaaattagactgttatatttaccctagtgtggacgtgaatcttctcttagttcccagaaattctttggttcctgtgccttggtgttgtagctaacctttatttattattaagatttttaaattttaattaaggtctttaggtttgaaaccttaagaatttcatgataataagaagcttaatacttttgaaattatcttttctatttaattaagctgtattttggtgcttttactttcagagctaaacctctctccctattcagtgttcacccaagtaaatttgaaagatgttattcttcattatattcaaaagtatataaattttactgtacatttgaagtttcatcataaatactcaagatcacaaggaattttgttaaaataaagcccttcgccatatcatgctgaaactaaatgcctatcctcaaaggcttttttgatctctcttgttttccattcttcccttaaaatagttacctatcatttccattaatttgcattaaccaccttatcatatcttgtggtctttaaaggaaaatgatatgctagctaactttatttttttcatacataaaacaatgtgtttaaccccaagtgtattaacaatgctttgcaatttcctgcaatgctcaggaaatatctaagactactataccaaaaagcagattgaatttgaattctatttttacatagtaaatataaaattgtattttatagtcctaaaattatatttaataaatatagtgtgaacagggtattattttagtagtttctgtcatgaaatacttatgcctcacaaaaccaatagtgtaaaaaaaatttcaagaacacatcaaataagttacagtttaataaacaatgatttgtccatgaagagtgattatgccttaaattaatattgttgcaaggtcaaaaagttgacattggtaacacaccactcttgaggatacagacattttggcaaaaaaataacccattacgggatcaaattagaaggaaagttagtaataatttaaaggtaattctaaaggtacaatatgtgcagatacacacatactctaaagacttctgcagacttttaatccaagcttaattttaatgtgttgtagacatttcttggaaaaccactggggtaaatcccacatcctcacctttttttttttttgagacagagtttcacacttgttgcccaggctggagtgcaatgacgtgatctccgctcactgcaacctccgcctcccgggttcaagtgattctcctgcctcagcctcccgagtagctggaattacaggggcccaccaccatacccagctaatgtttgtatttttagtggagatggggtttcgccatgttggccaggctggtctcgaactcctgacctcaggtgatccacccaccttggcctcccaaagtggtgggattacaggcgtcagccaccacgcccggccacattgttatgttaaatatgaatttcttcagagttaatttctatcaaggcagttttgattattttgacccaatagttttagtttccccgaagtcagcctcactgaatttaggaggacttggaaacacccagaaagtatcttccacaggttttttgctataggaattgtgtttctaaaagtttgtgccatcattaggcacatccataggaatggatctacattgtttgtccatgattagagaattgctttccctgatgaaatatttagatcccctggtaaaggagaagctgtggtatttcttagaaagagctttaccatttggtgagaaagagagatgtcttttgaatgttgcagtgaaatgcatgaaatgcagtttcatgttgtcctccccaatgtcttcaacacattctcttgggacaaaggccttcctggttgtagtaagaattttcagtgttcttagtagtcatttctctcttcagttcccaatataaatgttgcatattatgacttgaaaaacttagtttttgaaagtgtctgctggtcaggccttcttcctgagatggatccctttggatttttgcagctctattttgaaattgcacgtttcttccttataagtaccagctgtcattctaaaacatggatcttcagatcacagttcaattttccacctcccaatttgatgaaggtgggtttaaatgactcttcacctgccgagtttctacttctgtgcataggaggaggaattcttcttatttagattacatttattcacgcactactttcagagattcagtcgtctttatttatttgattccagtgtgctcttcaaatgatctccatcaatgcaggcctcctgatgtgcatgatagcccttatttactggttttcatttcacagaacatgtttttcttcatcttatttactaaaaatgtttcttccaaagtctgattcttttctttaagaaagaattctctctctgaatcctaaagccctttcttgatgtcttcatatccagtgactgagaaaataagaagcaacagactcattggtccatgttgagatgggagtcactgtatctctcctctgagcttttccacaattcagaagacagatgtcacatcctttaccaatgcatctctgacagctgtagcctggcttccagcggcctcctgctgagctggctgcttttcattctccagtggtgggaaacaatctgaaaacaacctgggtcaccagaggtcaccaggcctctggttttcctgaagaccccactgcttctccagaagctgccatggccaccttgctctgagaggggttttccttctttggcgtgggccatgcccctgtccagtaggttctctaaagctacattttgcgaatctgtcgtcttttggagagaaaggagttaagcttacaaattatatataatttctgtatattaattgaggggaaaaccccattgtctactaagtcagtcccttggagctgaatctcagctctgccacttgccagctgaaactttggtgagttaattaacctctctgggcttcagttttctcagccgtgaaacaaggatgatgacatggactcagtagggctgttgtgacgtttagatctaataacttatgtaaactaaaataccagcccagtgggtgctcagtcaatagaagtttccccttctctccagcagaaacctcaggtttctacctaccaccagttcttacctttggattttgtttttatcttgtgcattattcaatcacaagaacacataacatttagtcatgttgtaggattaaaagcctggagaaaacaaactactgccacagcatgaatgaagaacttaaccactgggaaaaactcagtattatttgattcatttcacctatgacagtttatgtattttgggggacagcagtggttgtactattattttaaagtgtacattgagatttataaagtgttaattgtgcttatattttcacccatcaaaaaatgattgtttttgcttgatttacctacctaagtttttgctaaatttggtctccttgaagctgggtatattgtctttttgtgtatagtaacttaagaatgtggaatgtgggcagacagcataatctatggtagttaaacttttattagattgttgtgaagattaaatgagatagtacatgccagaggcctagcccagcacttgcatacactaagtcaataaatattagtcattattctgcagtggaaaatttagtgtcactaaaactttgtcctgctagtcaccttaaaacagacagcataacctagtttttcatgttatcaattgagaaaatggattctaaagtcaagctaactgaagaatgtcactttaatacataaacgggtatattttttttgaattgataaaagggtctgtagaatattaaacagtagttattaaaagaattaattccatttcttaaagaagtttagtgtgaccaaccactagtgtaggcattggaagaatttagtatattttgtaaaattttttccagcatgggatctgactctctgaacctgaaaatgaagcaaacaaaacagaggcttgttctgcctatgcccttagtgccaaaacataaatcattgctgtattcatcaagtcataaaatttaaatcatctctatttgagttggataacttgctgcggtatttgatactaaccactggttcaagcaggacctggtgatgtttaatggactattgttcaaagttgttggactaagttgttgcattaatataaaagttttgcaaaataacatggttgtaaaagaaatcttccactaagcaatgaatataaatgaactttatttgtccttgtaaccaaatactgttcaggaaaattttttgctttagctttacagctaatttgccctctttctgggatacttttagggctgtggctaccgagtgacatcatatgtaggcatttctgtatatgtttctcttgctttcctattttctgtaggacagagttgccagctgtcatcctctctgggagggaaccgatgctcaaaaaatggcactacctttcctctcagcagtaaagtgccagtgtttcttttacagctgccatgtgcaggtgccttgacatggctgcatttggaatttagacgacagctgcagaaggtggaaccattggctgtagggtgagtggtcttaagttttcagctgagacataggtaggaagaggaaactgaaaggaggctcagcacagggaatgaaatcctgttgtttggattcttgaaagaacagggagaaatttcaggaaaaaggatgagaaattatttttacttttcagcaccattattcaggcacaaaatctggacaacaaattataaacttaaagcatttcaagtgtcacttaattgttacctaagtatactttaagtagcttagattaatgtattttaatgtaggaaattagcatagtttgttaaaagattttaattcgacagaccacagatgagtacacgtaaatacttagtaatgaactgctgcatcagcaggcatttgaggtttaatcatgcagtcaataatatagctcactgtcattaccttgcctggtccctgtgaaatttatcatatttttagtaagttactgtagccttaggtgagatttggtatttttcttcgttactaacacctgctcttttcatggtactctcaacaaaataaaatagttttgttttgttttggtagcaagcttaacaagtggttttttgaagtaactgattatttgctcttgtgcagtgtggtttgacctcagcacctttgctgtctaaaaatggtcagaagtattttccaaacttaaaatagatttttcaagatctatttttctcaaggaaactgtttgatgttcctagtgacgtaacaaatcaatcaagcaaaagctttagaaaatctggatatttatattagggtcaaaaagcacttaatatttcctgatattatgttaaaaatggaaactgtaagtttatactaatcgagttattttttgcagagaaattatgagatctttgatttttcactttgtaatgatgacagattcatgaagagtagaagaaatggctcagctggctatttagtagttagagaaacttgtgaagaagacattcagattctgcttatttgtctatacaaaggagagcacaggaagattaaccaggcaggcctgaagagaaatctgagtcagcatccttgctacctgtgtcaatggggaaaataggaaggcagcttaaataagtcaagactgttaagcatctaattactatacagtgaaccctttttccccttcagatagaagcatgattgttaaaagttcttgaaaccctggattgctactgctttcaaggcatgagacagatttgaaattctgggcagcaagctatcactttcatttgaaaactggcttctctttctttgtttcttcctttccccctttctcttttaaccaaaatctaacttatcaatcacaaagtttaataagagtaaagaatttcagtatttgggtccaaacctataaaatgtttacaagcacctccaaggatgtattgtgagcaatcacgtctatcctttgcgataaccttaaaaaaagttatctgttttctctccccacccaaatggaattgcaagattactttgtctataaatccttaaaaaacaactaaatccttcttcaaactgttataattttagctttatgctactttttatggtaagattgacaagttttctatcaactcttaaaacattcttttatttgccctaaattatttcaagtataagttggtattgcttttcttctagaattttgaaatttagtgaacaaattcaagtaggacacacccttcatactgttcgtaacactatatactcttttaatctgccttttgcattgccctttccctactgagaagtcataaccctcggttgtaatttacctcatacagcaatcaatgattttgtgatcactttagtttctttggaccttatccagcatctgtttatgtcttgacatgtagataccagaattgaagacaatttgaaaactggcttttctttgtttcttcctttctccttttctcttttaacccaaatctgttttatcaattgcaaattttaatgagtaaagaattccagtatttgggtccaaacctatataatgtttgcagtcacctccaaggatgtattgtgagaattcatgtctgccctttgtgggaataagtttaaagttttcttctgttaatgttgaaattaggaattcattttttctttaaattcttgcaaagcctgacttttagactttttttaaaattttacattccatttatttgacaaaaccattaacgtagctaatagcatggcagtgagcagttgtgcagttacataaacttcttcaggttataaagcttctattttgtatgatgtggcagtaattcagggagtaagtctttataaagtttctctaggtgctcaacttactaggagaactttggattcctttaaagagcaaggaaaaaatagtctcaaaaaaaaaaagactgtggcctggcgcggtggctcacgcctgtaatcccagcactttgggaggctgaggcgggaggatcacgaggtcaggagatccagaccatcctggctaacacagtgaaaccccatctctactgaaaatacaaaaaattagctgggcgtggtggcgtgcgcctgtagtcgtagtcccagccacccgggaggctgaggcaggagaatggcgtgaacccaggaggcggagtttgcagtgagccgagatcacatcactgcactccagcctgggctacagagcgagacaacgtctcaaaataataataataataataataataataataataataaaaataataaaaaaacactgtaatgtaattagttgaaacatgattagaatgacagttgaggtcctccctgcttattgaaccaacaataacttaaacaaacttaaaccactgatttgctaaaaacaactgtagacttttcagttaactacaattagtatgataagagcagagaaaaacctgcatttcttcatccttgtaaaacttaagtaaaaggctttaagtcaacttattaaaaatagaacacctttgtaaaatgaaaaaataaagtcattttttactactaaacaaaaaatatttttatttttagcgtaataaaatcaatcgttttatagttatagtgttgaaaaaatatttcttaccaactgcctctgaaaaattttcataaatactatttttaaatgaatactgatgtgagacagttccattgtacagcacagggcttggtacatcatagatgtttagtaaacgcttgttgatatgatgaaagtttggcaacatccaaagcatcgtaatcaggaggcagttgaatatatgccttctctccatcaggccgaatcaggtgttgaccttggccacatcgatgtcacagagcttcttcacagcctgtttgatctggtgcttgttggctttaacatccacagtgaacacaagcgtgctgttgtcttctgtcttcttcatggccgactcagtggtcagcggaaatttgatagtgtagtggttaagcttgtttctcctgggggcgctcttccgaggatatctgggctgcctccggagtcgcagtgtcttgggctgctggaaggtgggtgacgggcagatctttctttttttctttttctttttttgtggttgtggacacctttcaacactgccttcttggccttcgaagccttcactttggcttcagctgtaggaggggcaggagcttccttcttcgctttcggcgccatcttgtgaaaagggtcaggacaatttctagaaggattaaaggatgaatgctgtttagtaataagccgaaaagaaccataattttcaagtgattcttcatgattgccaactaagaataaaataaatatgaataatcaaacatttgaaattctgtatttatttctctaaaatcagcttgattgatgagaaagttactattgcttgacattttaatttttccagtttctgatattgatgctttattttgtataaaatggcactgtgatagaatatttactattctttctgtcataatagacttgctttaaactaaccccatcaaagtgctgtatgttcaaaatatcatcatgttaaggtaataattttcagtgtattagaaaagatttgtatagaaatatttattgtaaagcacgtgcgttttacactccatgcactaggttgtttttgtttggtctctgtgtatatatgtgtttacattcctgttgaaatctgaagaaggtggtgtgtatttaaatgttacttttagtttattcacatgaatgtgaatttctgtgtaagtatgtatctaaaattggtttagaaacaacacaatcagttttggtctggtggtgcaggatgaaatttatatacatttacatacttacaagtaagttgctttaaaattaaagtaggggataaaatgtagtgtgaattgttatgcaaaatctaagcacagcataattagcaagggatagtagaaatgcaatttgttaaaacctgaattgtaacagtcaattaatttcctcacaacgtgaaatagcaaaacaattaacaaacatcatttgtcaaaaacagtattaaggcaggttaaagaactacagatacaaaatttataaattataacattgaaaacagaatgttcagtagtgtttaaagatgttttgatatcttttacagatttttttaactgattgatttatttcaataaattttccaaaatcatgttaatactttccccttatgtatgtttggacttataacacgttttagatgtgagattttcctactctggacaaagtgagtctattggagaaagaatctattcattattaaagcaggggaaagtaagctaatatacatatatgtgtatatgtatatgtataatatatattatacatatacatatatattttccattctgcacttttaaaaaaatattgttttaaaatatatataacaaaattttccattgtaaccatttacaagtgtacaatttagtagcgttaattatatttatgatgttgtgaaaccatcaccactgtctatttctaaagcttttccatcaccccagagaaactatttttaaaataaaatctttattgagatataattaatataccataacattaacgtaaagtgtacgattcaatggcttttaacatatccacacaattgtataaccattaccatagttaattttagaacattttcatcaccccaaaagaaacctctgtatccattagcagttactcactatttcccccaaatcctctttcccctaaccctagtcactcaggaatctactttctatctctatagatttgcctgttctgggtgtttcatataaatgaaattttaaaataggtaggtttttgtgactggcttcttttttgttttcaagacctctctatgttggagcagatatcattacttcattcatttttattgttgaataatatcccattgtacggctatcccacattttatttatctattcactgattgatggacatttatgttgtttttgctttttggatataatgaataatgctgctgtgaacatttgtgtacaggcttttgtgtagacatgtattttcatttcattgagtgtatacctaggagtagaattgctaggttatatggcagtcctatgtttaaccattcgaggaattgccagacaatttttcaaagggatttgctccatttcatagtcccaaccagctgtgtacaagggttctcatttctccacgtcctggtaacactaattgttactgttttttttttttttttattatagtcatcctagtgagtgtgatatagtagttcattgtggttttgatttacattgacctgatggctaatgatgttttcgtgtgcttattggccatttatatcttcactggataaatgtctattcagatattttgtttatttttaagtcatattatttgtctttttattattgaattctaagagttctttatatagtctagatacaagcctattaccagatatatatgatttgcaaatattttttcccattctgtaggttgtcttttcataatacagttgacccttacaacatgggagttaggggcactgacccctgtgcacagtcggaaatctgtgtataagttttgactcccccaaagcttaaactactaatagcctactgttgactggaagtcttactgataacgtaaacagtctattagcacatactttatatatgttttatatactatattcttaccataaagcaagctagagaaaaaaagatgttattaagaaaaacatagagaagaggaactattcttactattcattaagtggaagtggatcatcataaaggtcttcattcttgttgtcttcgctgtgagtagggtgaagaggaggaggaagaggggaggttggccttgctgtctcaggagtggcagagggggaagaaaatacacgtatagtgtacacctgcagttcaaacctgtgttgttcaagggtcagctgtactttctttttgagattctactgttgcttctctctgatttctaattatatcacgactttattttgggaaactctgaactccttacggggtgtgcctatcattgataagctgagaaaggcctctgtgctggccaaatccatttcttaccccttggctctgtgctgtagaattcaggaagcatttattttggtatctgctaatgtactagacactgtgaccaacttttgggaataaatataagatggaagccattctcagtaagcttatagtctagcgaacaggtcagggaaagctgagttgtcaggaaaatcactgtctttataaaccaaggagagtttattttattagatttatgatattaacttgcagatcatagaaggagacttgaatatcactgagtatattttacttcgtggtctgtaaaaagtagtctagtacgatgacaaatggcctgtttccccacattttctttccattccccctcattggagctctttgctcagtctctctgggccctgaaagtttacattgattccttattcttgtcttttcctgggctgtttcttttctctttccttatccaagtctgtctgggaccgagacttaccttctcatggctcactgcaccctcaaacttctgggctcaagagatcctcccacctcagccccctgagtagctaggactacaggcatgtggcaccacactcagccaattggtgcctttctgaaggtcttcttttcctctcccattagcatagtactgttaaaccttgcgtcttgattaatattctcgtgtttgaatgcttagttgctctcgtggtttgcatgcaccgtagagtttgtactgtttccttctttggtgcactgtgtgtggagctgagtagaagaaacatggtaaaagcacagtgtactgttctcactttgcaacatcagttgggaaaatgatagagggaagcacttggggcaaatgggcaaaatagagcaatgggttagcaaatgcagaaaatgatatagttaattaaacaacctgatatgttgagttgaaggcaaagaaaatatacaattttataattgcattttagactatttaaaaatgctcctttctcttatccccagccttttcattagataagcagttttcgtgtgctaacttggaactcacatacgtttaaagtctttcatttcacacacgttgcttaaatatgtgcatgtagtttttgccttagctactggcctaataaaagcctcttgtgaatgcttatcaccttgtaaagtagttaccagagctacagtaaaattggcctgcaagtgaaaaggctttgacttccctagaggaagaataaaaaacatatgagacaaatagcagcaactgaaattatctggtgcagaatgtggcagaatgccagccaaatgccctgtccctcagatgtttcacacctttatcttaattcgctaaaaaggccaccttatttaaagaatttcaaacacaacttgagaatgccttattattggctttgacacagtttacacatacaatcctgtttcttattgctatcttctggtattaaggccctatagatttaagagattttaaaaaaatgtttatatttcttttaagtggagtgcatgtttgtgtgtgtgtgtgtgtgtgtgtgtgtgtgtgtctgtgtgtatgtgtgtgaactgttattggaagttattgccatgtttattttaggcacttcatatatctaattagaaatgatgtttattgttaagtaggcaaagttgccttcgagtgcatggtgagaaatagtaatgagatactttagccattaggccatgaagacttttacctaaataatagggaaggaataaatcctagtattgttttggagttgctacaggagaacagaaattgtttaaacgagagagtttcaaaaggccccactacagttaagtatatttaatttaattaggtaatcagtattattcttgcaactattaatggcacctcatttgtttaacacttgctatatcatagagcatttcatacgtgctactttatttggtcctttcagaaatccctagaacaaggcagggcaaatgtttccatcttggttcatggatgaggaaaaccaagactcaaagatatgcagtgacttggtcaaggtcacagagtagtagaggatggctctctttccattacagtgacagtcagaaagcgtcaaatcttaggttatcatgacacttagtaattatgaagtatattttttccaagaaataataagccttttaggcaattgaaactgccgagaaggctgccagaggagtaactcaaaacagaacaaacatggaggtttttggtcctttcatctctagcattgagtccactaggtcagggtttcaggaaatgggaaatcttcattgttacctgctaggttgccttatttctccatttaatggaaaacttagtcttcattattttcagtttaacaaataattttccttagaggaaaagaaagttttgcctgtattttggggaaaatgtatagaaattaaatctaaatcattgaattattagatgatgtgccatttctgagccaaaaaagtaggaaaacaatgcataatcatctaataaagtatatgttttatgattatatatgtttcttgttttgttttgtttacagtggcgtgatctcggctcactgcaacctccgcctcctgggttcaaacgattctcctgcctcagcctcctgagtagctgggactacaggggcctgccaccacgcccagctaattttttttttttttgtattttcagtagagacggggtttcaccatgttggccaggatggtcttgatctcttgacatcatgatccgcccgcctcggcctcccaaagtcctgggattacaggcgtgagccaccgtgcccggcctatatgttttattttataaagttatatgttttattatttactttttgttatgtaattgtttatgtcataaaattataatataataattccttaaaccaaattatattccataaattataacatatgaattcaatatgcatttataaaataaagatttctagacatatggtagactaacagtgatattttgaaatctacttctgccacagaactagataaccatttccagattggaatataaattaatcaatgtctcattgttagagctgctgtaattttttgaggggatcaagtgaggaaggacttatttttggcttagatttacatttacagcaaggttatcaacattttcctgtggtggcacattaatattaataatataatcataatgccgatttacacatttaccaaattcccatctattaccttcattcctgttaaaatacaacctatcatgttgttctttggggatgagtagtacatttatagacatataagtatatgtgtatatttatatatttgtatatataaaaatttaaaaaattcttttatttttaggagcaaaaatttggggaaaataatgtaatatttatcagaaggatactttaggatttagctctatcagccaggcagggtcatcagtaaatctaagaactgccaaacttctcacactcctaattccctcttttatccctccttttctggctgtgctagagatatcctattacacatgattttcttttactctgggctcttcttcgcccagatcagtgtgattgctttgcattgatttctgtatttgcttaaaaaaaatttcccttgataatgtttttaaactttctagcatgagcctttccatacttggtattggtgttttataatagatttgaggacaggtttgtgggggattccataacaaattcaatttatcagttacttctttttaatgttaaaataactgcaacaattccacaataaatagagtgaaatttgatgtgctaaattaatttaaatggttttgacacattttccttgaaggactcttttctaggtttttataatctcacctcagtgagagtacagtatggtttaattactttccagcagtgcacactttaatagcccgtattccacgtgaaagctatgtgtcttctgtgggtttgaactgtttctgcctaatccaaggaaaaatatttgaggaacattagttaatgccttttccaggaatgggagtgggtaagcgtttttttcatggcttatagaatatttagcaattttagcttccagtacttaattttatagtgttctcagtactggtggcaaaggcttccttcagaaaagtgagaaattatgtgaattcccctcttggcatgcttaggagggcaagtcatgaatctttactctcatatttttctaaaataaaactgggcgttgatatttgctgtgatctaatatgtagatatgatgaaaagatttataaaatagcatatattgagatttttgtatgttctcataaaaggtgctataaattgaaacatttattacacagaaaacgtctaagataagagtattattttccaggatagtttatctaagttctgtaaaacttttaataatgtaagtaactactaatgaaaggacgttatgtgtcacatttgcattcataaatatccatgaaggatctctttcaccaatgttattcagtctcagtccaagacaaggtcagacattgattatgtttgacatcttaacaaaagtgaatagggaagataaatattcttaattatactgctagaatggtgagaagcagtggtctataatgtaaggaggaatattagcaaaatagaattatggtcaattgcaattataataacttctatgcattaagtatcttctactacatattagctctttatatatgtcttatataatgtaattttaactaatatcttaagaagtctaggtagtatttatacccatttgcccaaatctggaaacggagtttccaaaaaattaaataaattccttaaaactgcccagctagagtccatttcacatctgtcaggctctactaagctgcttgtcagtctttgacttcctcattatcagagatagatatggtattgataatgtacaaattgtttatttggcccagaaatgtgtttgtgcttttaaatttgaactaattgtctttggcagtttgaaatgtacaatacttgatggaaaataataaaactccactccaattagaataactacctgatttcttgattatagcttctttaatgacggcccattttatattatacacggtttcatatttttcttatatttaacaaacacatatacaacactactgtgtgtaaggcactgttctaagtagttacaaacatgaattcatgtaatcctcaccagtatacttatgaggtaggcattattttatccccattttacaaataagataaatgaggcacagagaggttaagtaacttgctcaaaatcacacagctagaacatggcggagctgagatataaacccagtcagtttggctgcagagtgctcttaactgtatgtatttttcagatgtttcagaatttggtgaaagcaataattgttctaatcctattgctggatttaaaagtaggaaagggtaaatagagatagcaaacagtgtcaataaagtatttaataagaagtaatgacccccataatactttgaaattccctatattaaaaatacaagatgaattgtaaagagaaactgaaaaccagctttaactgtgttaaaagccagttgagacttctactttatttatccatttgatattatgcaggcttctctttgtgtatatagctgagcaatgtgaatataatgctgtcattattgttttctgtgttataccactagttacattacttcagattatgaagtacagtattgagctctgtcgttgactatatctctccccaattatatgtatcatgattttagcccatattttataaatgagagataattttaatgaatgtgtggggcaaataaaacttttagagttggtatgttaaaatagggctaaagttaaagtttcaagaattgtagagagagagagactagatgtgccaatgcaaacaatggattggtgaaactgaaactgaagaaatttctgataagttagagatttttggttaactaagatttcaacctgtgtgaatctcaattttggcagaaatgaggaatgtaagcaattctagctttgcaatgtggaaaagtcagggaaactaaattagactttgcactaacacttcctataagcatatgtcaccctgatattgaatgttgtatatgagggtggagggacaggtggggacaaacacccagctcctcctgggcttgagccaaggacctttggcttcagttggatcttgtaactgccctgtttacctgtaatcagaggcaaatttaccaggagtaaatttactgggatttaggtttcaggacctctgacttgcacagacctcctccaaggctctgcgaggacctctagcaatgtgttcacgtgatcatatggttttgcaaaatttgaggaatttaaaggtatttaagcataattagttaagactgctatctcttttctactctgacggtccttctatcacatttcctcacacaggattgctttggaatgatcacaggcatttatcagatctggctaaagggaaattgagttgagaatatacaactttaaactatagtttgaaagatattttgaaacatttcaataagacaagggagaaattatagactcctaatttaggtacatagggttcattattttctcatttttgcacttattttttaaagaactgagataatttagataatggaacataaaactaaagcaacaaagatgaatgatgaaataagtagaaattatttgatatcaaaaagcatgttgtaaaaaaatagattataacaaaagcagtaatgcattgaaaagaaaagtttctaatagagataataaataggcttgatagactacttgaaaacttagttaataaaaaagagtgaatcatatgaatacactggggaaacacttaagtttctcttgatttaaccacaaaatacgtatcgagaaagacaacataaaatgtcataatatgtaactataatgagctttataattaatgagtatcttcaggtcaaagagtatatatattagttgccacatatgaaactttgaaataccctgaaattttgcaactcataaaagaaaaaaattttatgaaagttttcccaaattttacagtgatcctaaaaacccgacatgagttgtgaactgaaaagaatctttccttaacacatatttctaaaaattctttttatagcataattagaagagatgccaaattattttttaatttcgtatgtggaaaattgtgttataaaattgtcatttgtcaaaatatgtataatcaaaaattttagaaaaaagcattatagaggtttgttggataaataaaaataagatggtatttttctgaatttcatgatgtttattttcagctatttaaaatttgtaatttttctgttctaaatatacttccactttctcttctaattttgtattcataattttgtattctttttctttaaaaggtctagaaaagttgcataagattcagttaccctacaacctggatccaccctggtctgtagttaatggttttaaacatgaaaaaatatatttattatgtagcatacatattccagaaggcataaagtgagaagtaaaagacccctcctccactctcatttgtaagcccaaaaagaaaatacttgaccttctttatgtattttttaaaattgttgtcacatcatctttttatttattttaatttttgtggttacatagtaggtgtatatatttatggagtacatgagatgttttgatacaggcatacattgtgtaataatcacatcacagaaaatgaggtatccatcctctcaagcatttatcctttgtgttacgaacaattcaataactctttagttattttaaaatttacaattaaattattgttcactatagtcactcttgtgttgtcaaatatttggtcatattgattctattatttttggcacccattaaccatccccatcaatccccccaactccccactactcttccttgcctctggtaaccattcttctactctctatttccataagttcaattgttttgattttgagatcccacgaataagtgagagcatgtgatgtttgtctttctatgcctggcttatttcacttaacataatgacttccagttctatccatgtagtcacaaataactgggtgtcattctttcttgtggctgaatcatactccattgtgtataaataccacgttttctctatccgttcatctgttgttggggtgcttaggttgcttccacatcttggctcttgtgaacagcgctgtaacaaacatgggagtgcagatatctcttcaatatactgattttctttcctttgggtatatacccagcggtcagattgctggatcatatggtagctctatttttagttttttgaggtacctccaaacggttctccatagtggttgtactaattcacattcccaccaacagtgtacgggcccggtgtggtggctcattcctgtaatcccagcattttgggaggccgagacgggtggatcacctgaggtcgggagttcgagaccagcctgaccaacatggtgaaaccctgtctctactaaaaatacaaaaaattagctgagcgtggtggcgggcgcctgtaatcacagctactcaggaggctggggcaggagaatcgcttgaacctgggaggcggaggttgcagtgagccaagattgcgccattgcactccagcctgggtgacaagagcaagactccgtctcaaaaaagaaagaaaaaaaacaaagcaaaacaaaaaaaacagtgtacaggggttcccttttctccacatcctctctagcatttgtaattgcctgtcttgtgaatataagccattttaactcaggtgacatgatatcttattgtaatttttgttgcatttctctggtgatcagtgatgttgagtacctttttatgtgcctgcttgccatttgcatgtcttcttttgagaaatgtctaatcaaattgtttgcccattttttaatcggattattagttttatttcctacagagttgtttgaactccttatatatactggttattaatcccgcatcaaatgggtagctttccttatgtatgttttacagttgttcagatctgctttgttcagtagggtggtgtgcactaaccagccacatgtagctatggagaacttgaagtgtaacaaatatactgatttttaaattttcatttcaccaaggtttaattttaattcagtttacattttaaatgaataatttcattattggaaaacttctaagtatatttaaaacaacttgggtttgtggatttatttttttcagctgtaaattttctaaaatccaaaggacatcactgcagtatgtgtacatgtggtgtgtctgtgtatatacatatttttttccacaaacgagatcatactctgcatcttagcttttcaacttaaccgtatgattgcacatcttttcgcagcaacttacagatttatttcatttagttattagcagtataatattctcttctgtttttatagtcttttttcatacagctgctggggtgattctttttaatttaagtgtaagtgagatcatgtcactcctttgttcacaacccttcggtggcttcaaatctatctcaaaaccaaattccaagtcttcactccacatcgaatgcctgccttgatctgttttctcactgctattttaatatggggattagacacaaatattttattctttaaaaaatccatcagaaatgttatttagtaaagcagagactttccacgtacaaaatttaaggtcttgtttagtgtctcatttattttaccaccaccagttccttttaaagacaccccatttttccttcccaatagcactcactgaagtaatataaaccttgttaactgtagtaaaaaatgatgcagactttctctaatcaagagctcatttacaagaggaaatggtgttatggcagatagctgaagtatactgtgtcttaagaatttgttgcctctttcttgctagattgaatttcagaattcagagtctaaattttctctttcacatctggtggcactttttaaaaaatcagtgtgcaaaaaggagaaaaatctctctgcttcctctttatgccactcactacagtccagcctatgccaggcttaaagaaaaggcttttgtattggcaaagacactccaaaatggtttccaagtgcattaaaagtcaaggagagttttgcagaaaaatttaagattaaaaaaaatccgagtggttacaagttaagaaaccatttttaaaattaagcaatgactaccaaaaacatgctggctaagtacgtatgtaatgttagcatcccagtgccactagtgcaaggcagactcccatgagccatttaaacataaaagttaagaaggtagaattttagaagttttaatgattatttgaaatctcaagggattcttatacaagatatggtgatggttataaatatatggactgacacacacttatcactaaataaatgttttacatgaacaaatgagtaaacaagtaaaccacattgcttggaataagtagtgtttgttagagctttgagccctgggagcgggggactcaagaaatagggagacttaatcagaaagaaaggactatgaagtgatatcagagtaaatgctaaaactaggcatagtgtgaagttggaccccaaagggtaaagacggttgttggaaaatgaagatagccttttctgtggaagatcaggcaagtaaccaccccagtttggagttatcatgaaatcagacttgaggacatgtggatttacacctggtgaattgaccaaaaaagagcttgttaatgtgctcagagagttgagaattaaagtgtgagtggttctgaactgagtattgtttgcaattatttatgaagaaagtgacagaaaatctagcttatcctggcttaaatgaaaaagggcatctgttgacacatataaccaaacagtccatgggttggactcactttgggcatatcttgatttaaggttccaaagatggcccaggatcttattctttgtgtgaaagcctcatcttagaccagccgcccctttctggtggcaagatggctacagcagctccaagccccttactctgttctttcatgaatgtgctggtcactattgtctcccacatcatgggttgctttttactagatgtctcttgttaaaaagtttttaattttagcgttaagtttctcaatctgtttcccgtttggttagcactttctgctgtgcaagtaatctttgcctcccccatgatcaagaaaatattcccttacgtaatctgctagacacttatactgttttaccaatcatatgtagagttacagtctgctcagaattccttaaagtctgggtgattctactgggcagccagggttgaagacctcaggctttgatgttgctgagttttcctgggagtctttggcactgctacagtgtgtggtacctgcttgcctgagagggaagtaccagtttgacagaatagctacacattgatctgttttgtggtaaactaatatgctccttctttgttttaaatgaatgggattttgcctttctttgagacatgagttactacttttattaacagatgaatgatgtaaatgtgttagttgttagtaaaaggagaaaaatccagagagagtatccattcataagcaactatcaattatattatgtattcaaggtgtcatcttggattctgagatgttgagactcttcaacttcaagactccctgatcctttattttcacattttttcacactatgaggtatccaagatgtgagaaaataaaattattccagatggctttccttttctcattttttagaatgtttccgtctaatcctctctctcaaaagaaacattccccttggaattgcttctgttattatttgtattcatttttaaaccttgacaaccatgtgaacgtagtacaggtgttttttttaagagagtgatctataaagtaaagttctttgtgctgtgttgcagaaggagaaatacttaagctaccaaagtaaagctactttaatctaattaaacatgctttggagccagatgtaaatgaggtaacttttttgaagagttagtttacagatatttggtcattctcattttagataaacagaaagccatgttgattattatctggatctggctagactcctgttcaaccacttgctagctgtggggacttgacaatttctttagcttctctgaaatgaacatggtagcaattcccacgtttagggatgttgtgtggattaagtagagaatgcagagaatgcagaaaaagctcaaagctttcaatgcctggtacgtaatatatgcccactaagtcttagttatgctgttggttccactcccgccaccattccagaggccgcagcagggttctgtgttgtgttgtgtttgatcctatcttcttatggtttgtctagagtggaagttttggggtaggggtcactcataaaacagaaatgcaaaagtagagggaggaatctgggatgtggtttatttaagatttttaaaatgtgcttgcttgtttgggtttttttaaaattatttttacattattattattatttttaattagagacagggttctccctatgttgaccaggctggtcttgaactcctgggctcaagcagtcgttctgccaagcctcccagtgtgctatggttacgggcatgagccaccgcgtttggccttggctggatttttggtttgtttttcttaccttattttgagaactagagtcgtctttgctttccctttttctcacgtagcctatcccagtggtcttgaatcattccctatgtagactgcctaatctttatttccctctgtttatgctgaatttttatagcgaagatcttaagaaagtgtaaaagctgtttttacccatctttttatctttaaatttttttatataataattaagctttataaaagttataaagtataatacaaccaacatccacatacctaccatccagctttagaaagaaaacatagtgggtggatactgtggaagctgcctctgcaccttcagcctccattgaagaagccattcattcccatgccattttcttatacttttaccatatatggtgtgtagttccaacctatttaaagtaccgttttacttatttaaacattttatataagtcttgtcattttctttgtattctgcaatttaccttcttattcaatgttgcatttttcagatttatacatgttgatgtttgtagctctagttcattaattttgactcctgcgtaatgtttctttgtatgaaggtaccacagtttatcctttctccgagtggtgggcatttgtggacactctctctctccccaccctgttagagacaatactgccacacaagtttttgtacatatcttgcttcacggatctttgtagctttggttttgttgtgtttgtttttatacagaaaatgagttctttggggactagtcaaattctgtgggcctcagatttttcatcataagattgaactagatcttttctagctcaaaattgcacttcttacatggttatttaaactggatagcttgaattactggcttttgttgtttgtgttacctcacaggcccattagtatatctcttcagtagattatgccggatatggattttactctgacatgagaaacttccatttgcaacatttttgaggacaaaagtgtatgtagtgttagaaactatcattaagcaggacacaggacactaaaccttccttctccccaagtttgtttatctttcctggactctacaggaattacaactgctattaatttagaataaacatataaataatatattttaaagtatgttgtctacatgtgctgggtcaccttcatccggcatcagcctggacagaggactcaggccctctacttgattccataagagtccggttacatcgagcattttgcgccctctttaaacttgactgagaatttacaaggccacggggcttacagcattctatttttctttttgcctttctctcttttttgcttcgtacataaatgaaaatctaatgtaaaattgtaaatgggaaaagtactatcatgaagaaaaaagtaccagggaacctgaaacgagattaaaactgactgaaaggatctaggaaggagtcttggaggaagggaaatttaagctggtcctttagggatgaagaccttaaaggtgtatgacaattagacatgcttgtagggaagaaggaggaatggagatgctttccaggcagaggaaagatatacgaggggaaaaagtataagaccatgacatattcagggaacagtaagagaagtggctcagactttctgggagacagtctgccatattatcccccttcttccctaacttaggcagtgttaaaacatggctgcatattctttgacactctcccattgaaaagttgtgtcgacgccccctcctcttgaatctagacgagctgatgactgcctcagtcaatagaatatggccaaagagaccctggcttacaagggtcagttgcaaaaggccatgtgacttctgctttgttttctggaacacttgctcttggagcccggagccaccatttaagaagtccaaccagcttgaggccatcatgctgtagaggcatgtgtatagatgatctggttgacgttcccagctgaacccaactttctagccattctaccaaatgtgagtgaagttgtccttcaactgttttctgactaccagtaccctagagcaacctctaacatcactacacagaacagaagaaatgctcaagctctgcccgaatttttgactcacagagctgtgagatataatacaaataaccatcctggctaacacggtgaaaccctgtctctactaaaaatacaaaaaaatacaaaataataataataataataataataataataataataataattgtcttgagttataagtagtttattatacaccaatagataactggaataccaaccaaagccaaagtgaggggatttttctttagatgcttgctgaagacaatattaagtcatccaaaaacctctccccagaatatactactgaatgtaatttagcacttatggcaggaagactgagtttggatagcattcaaggcagaggaaatgacatgaacaaagatagcaaggcagggaaggacaggacatatgtaaggtagagagtaattaggttcagctaggagtagggcacctcctgggcacagtgaaagaatagactaaaagagaaggttaaggacatgctatgaagggccttgaatgtgagattgaagaaaataacagtaccactgaagattttttgaaaagttttactagcaaaacagcacttttgggaattttttcaaatgcttgtgggatggactgaagtatggagaaattaggggatcattttggaagctattgcaagatactatgtgaatcagatctgtggtagctgcagccagaatgaaggctggaaaatagataggaaatactgtgggcaggaccaccactgacctgcttagtgcattttgtgaattatgaaaaggtcaccccagctgggcacggtggctgacgcctgtaatcctagtactttgggaggccaaggtgggcagattgcttgagcccaggaattcaagttcagctcagacaacacggtaaaaccctgtctctacaaaatatacaaaaaattagccaatatggtggtatgtgcctgtggtcccagctactcgggaggctgatttaggagactcaccagagtccaggaggtcaaggatacagtgagctgtgatcgtgtcactgtactccatcctgggtgataaaagtgagacctaactaaaaaaaaaaaagtaccacttctttaagacattttacttccatctgttagaaaattgttgtaatatgtttattagaataagacacttgactgccatctgctggaaaattattaaagatatgtctttggtttcaatgctcctctccttttcacatccttgtgcagtacacaaattttgtgggtgcgagtaataggacttggtaacggatcacatttcttattaaaaggaaaaggaagaaatctcaagtttggatggtagggaggttagtagtgacattaatagaactagaacttattattggggaatagatttataaggcagaatcattctttacatggaaagacactcatcttattatttattgatcccaattgtttgcatttacttagtaagaattttgataccttttcttctagaatctcagctctccccccttgtgacatctgagaatgttgaccagttcctcttttgtattccatacacccctctcttctgtatcttttctttctattctgaacgttgcttcttatccgtctcctttgcaggcccttttccctcagtttccattcttgtgcttttttatacagtgggcgctcaataaatgtttgtttaattgaattgcattgcttttgaaagatcagttgcaggtttttcaggagactgattcataggcagttagggactaagggcgtgccagaattcagaaagtagaaacctatcctaaatacagttccttgtttcgggatgtattttttacacagtaggtcactcttccttggggaatatctgtactgttgatccgttcatcattgttcagcagtggcaacaccaggagaacaaattatttacattggctgtgtcatatgggtgtgtctaattcggagaactttcaaacaaaataatgaagcttccccagcttctaacttgggaagtatgaaaagttacttaaaaaaaaatcttgactcttgtttaagtacatcagtgactgattaagtcacaacacattttaatattttcattcgaggtttcttgctaacattcttaccaccactaccactaaccccaccccatgtgtgtaagttacttttcctttcatttttcgtgggtcttgtgtgttaaggcaaagtcaagaactttgctcttctgataacttaacattgattgtgtgactgctttgtgcaaattgctatgggatgcctcatggaaattacaaaggtttcgtttgcttctgcccttcaagagagacttgcttagtgggagaagtagatgcatatgcaactgctccagggcaggcgatgacaaggatcataatatagtgcagacagagacaggattccctgtcttagagtgatataaacatcactcgaagactgagtcacatatatggacttgccatatttctttcctaaattgcacacttaactcttcactttcctgggctggattagaatttgttttcgtcgaaggcttcatgagttgaaagcacattacatatatgtaagatttaatggatttaatttaaaatgcattgaataacattaattttagcaggtttgattgttttaaatgcttttaagccggcactcttaaacgaaaatagagaatatcagagtgatattaaataaacaatgatataaaacaggagttttatgtttatggaaacctagtatttaggaaataaatatcctgaaattctctagccaaattatatttttaaatgttttgagcataggatacaagttataaacagcctagtagggaaaaatgtatattactgtcataaacataggtagtatttaaaatattaaatatggataattgatatttaattgaagtgctttttatttaattaaagccaatgacattttaaaattatttctttattaatttttcttcaattaaattttagcctgtattttagatacaaggggtgcatgcgcaagtttgttatatgggactattgcataatgctaaggtttggggtatggatcccatcacctgggtagtgaccctagtactcaataagtggttcttcagcccacattctcctccctcctccacccccagtagaccacagtgtctgtcattcctgtgtttatgtccatgtgtgctcaatgtttagctctcatttataaatgagaacatgcaaagccaatgacatttttccagtcattggagtaacaaagacgtttgaattttaaaaatttaaatatatttaagattgaaatttaggccgggcgtggtggcttacgcctgtaatcccagcactttgggaggctgaggctggcagatcacctgaggtcaggagtttgagaccagcctgaccaacatggagaaaccccatctctactaaaactgcaaaattagttacaaaaatagtagagtgatttatgtaataagtaaacagttcaggtttacttgacttaatagcataatgatttacagcttttacttaaattcattctgagatgaaataatacagcctctaggaagatacattatctggttttcctttgcattttcattaaaaatctaaaattggaaatgaagtatgtcaactagttttagaaatgatagtaaattgggaagcatctcaaatagcagtagaaaagaagataccaaaaaggtttagaaatatcacaggaaatagtgagattcagcctaagaaaatgcaagctaatacatgtaagagcaaataatctgaaatagatatttaatgagagacaatgcttagtagtagtgaaagggagtcaggtgctatcagacagcaaagcagatatgaggttgcggtgtgatacggcagtcacagagctgttgccatctggggggtcatcttgcaagctcattacaataaagcagggaagcagaaatctcttacaaatgtcagtgttaagaccacatttgtcttatatcaacttaagaatgtccagacccatagctatcaatatattgagtgctgaaagaatagaagctgcagttcttagaataggggagaatttaatgtaataaaaataattttaaaaaataaaatatctttgcttcggttaagtagtaaggcaatatgaagttatacagtggatataagcaacttgttggaagacaaatttgtttagatgaagctgagactgtggaaggtgagagtagtgtgaacttgttcataggcagttctcaatacctaggccaattatgcagatagtgaaataacatcttaaggcagtgatgggagctggatcacttgaggtaagtttggactgtatgaggaactccattaggtaacagtgccggaattgattggaagcagtgtgttttaacaatgaggtcatatttttaatgttgtctatactggtccaattactctgccccttgtttacaatatgtgattcagtgcatatactcaagaaccattcttatgtcttggcaaggtaccctgccctttctctaagcaccctttttgatcttggcttctagaatttctttgactgctttacttctgatctccaaaactggcctgctgtttcttttgaagcacttccttccctgtatgtacctgctgtatcttagctctgatcatgtttgtacttcagctgtcactgcctactactggtgacacctctgctctgctctattcttaatatcattctttttttttttttaaaggacatagaaaatcaggtattgtcttgttgtctttaagtgttgacacacttaaattcttgaagtcctgtttttagtcttcccttcccaaatctgacaaatatatagctttctacttatgtcagtgaggacaacatctcactgatcaaaaatctcaagttccttcactcatatcttgcctctcatcagtttactctatgtatctgtctcttctgtgtctgtcctttttcttccagtagccaaatttttaacctcgccttgagatctttctttcaaaatactcctttggcttcgagtgcagtactccagtgcttaaaaacaataatatttaatcaatcataccatagcttcagaaaccattgatgacttgtaaaaagttctaattctgattaaattttgatttttggctactcttatttaaaattttatgaaaagtaaatttatcatattaaacaaatttaataattttggtagcttaatattacaattctaaaatttgctttttaaaattgaaactgtttaggtcattgactttgtatacttttactgacccattagtcatttcttgagttttgtctctgtgtcagggattgaggtaggcctgccctgagggttatgaatgaggtgtggtctttggccttaagaagctcacattcttgttatgagcaatacttttgttgactgagaaatcattaatatgttcagtcaatatttattgagcttcaaactctctgttaggcactggggatacagtatgctaagcaagaggggaaactgggattcctacaggcttgtttagtaagcatatatctatctggttttataaatagaatgttctactcaaaattttggaaataattttttccctctatttagtatctgagttttttttgaatacttattaatttcttagtcaacaaagtagtccttgtatatataacaaatggtagaacagttctcctcagttacatatcgttgtaatagtggaataagaattgtaatcagaattagccttctggtcatttgtttgggatggatcttctgttagaatccagatatggcagatagaaccgaaatgtagcagtttccttcttttaatgttaacagtgattgtgctaacacataagattataatagagcagccttgtcaatagcagcaaaatttacttgtctgtttttctcccagagtacatgtgtagttaatcaatttttaaaaatatattttactacaagttattgcttattccaggcatgcccaatgacatgctatttattacttctttttgcagatccacagtttatattaggaaataaaacttctactgtttaaaattgaagttcatctgattaataaactgatattgcctcaggtttcaaactccgtagtgaataaaataggtcctcgtgtagtttagaaatagtataccagctgcaagtccagaaaatacttgctgttactcacataataaaagaactcccaaagccttataatttatatattcataactgcttcttgttgaatttcttcttctcaatcatacaggtgctgctttggtttaaaacttacagccctctttaggcaatctacagtttctccaaagtgtttaatttttttccttcttatattgtgagctggttaatgttgaagatagcacttcatttaaagttcaaacctgtgattgttttaaaaacttacctagtattcattttttcatttaaatatatatgtaatttcctacaaatgtgtacttgtttatctaagatttggacaattcattttaaaccatattattcatttattttgaaatattaagatcctgccatgttccaggcacagatccagatactgactgcacattggtgaactcagcaaaaatccttgcctttatggaaacttactgtctggtggaatttatattttggtggattctataggcattcttgcctattctgctttcataaatcctctagacaggtataatataagcaacagtttcaagttctgtcttttaaggtcctttcacccaaaaaaaagatggcatgagtgtattgcttcagagatgatcattactgtttattgtgaatagtgagcatttcaagaaattaagctcttttttttttttttgagacggactctcactctgtcacccaggctggagtgcagtggcacaatctcgcctcactgcaagctccgcctcccgggttcacgccattctcctgcctcagcctcctgagtagctgggactaacaggcacctgccaccacacccggctaattttttgtatttttagtagagacggggtttcaccatgttagccaggatggtctcgatctcctgacctcatgatccgcctgcctcggtctcccaaagtgctgagattacaggcgtgagccaccgcgcccagccagaaattaagctcttaaacaaaagtaggattaaacaatgtgcgttgctaagcatgtttattttaggtttcaattccagagtaatagtagctggaaagcagcatttttacacaatttaataaaaggataaatattttttcacgagatcatcagtagtttaatatggattttgtagtaaagtgccagctctggatcataatagcaacaataaccgttaccactcacaacagtaacagttaggggccaggtactggtttgaagagccttgtttatatttatgagtttaagcctcaaaataattctttgaggtagataccattattataactctgtattacatataaagaagctgagcctaagcaacttgcccgaggttacaaagctagtgagaggcaaggctgagatgagatcccaagcaagctggctcttcacctctgtgttctactgccttatatccttaaatactgtatatgctttcttgcttcttcattctaggaattagctgtctttcagatatgtaaatattaatttgtgtagcacatgtcatactctgaatgtgaacatgaacatactggtttttctattatgacttttttttcttattcatgactttcctatcttagaaaggcttctttttaaaatttctagcccataggaacctggaaatttatttgtttgggttcttgtgtttgcttactttttaattaattaatattatgatttgtttttatatgcccaataccctggcagatttatcaaatttaaaatgaaaatttagtcaaactcattgcctaaaaattttatttttctgtacctctggaaaaaaatggaaacagaaaagcagccttcattcttcccataaaaagagaacaagcataattttgccaaatgtgtgttttgagagggatttcctcatttcttaactgcagtctaacagaaggttatttgggcttacttgtcccacttcagacttcttactggagcaagtatttctgccgttctgaactccacacactgttctcttacatgtctaggctgtttgcttcctcggaccatgttcctggatcactttcttcttctgcctatgcatttctgctcatcctccgagattaaactgccatcagcttctctgaggaggcctgaaaactcctcctgctctggaggaattgctgccttcaatgtcgtgcttcattttattcgctcatgtgtttatcaattaaactccttgaagacaagtgttattttttttcctcctacttgtttcactgctgaatcctcagcactgaaagtagtgcctggtatatattagatatttcgtatttgttgaataaataaataaatgaatgcatagtatattatcgcactttactatattatatgtaataattttgtactttctcttcttccccagacagtaagcgtcttatgttattcatctttgtatgttttccagtgtctataacatattaattaagtcagtagctgtttgctgaattaatgagtgagcaactaattaatacctatagctctctgtggtattagatggagatgattaaaaggagggggctagaatgagtggtgactaaaaggaccagtgcattgtgaatttctgaagtctgaatcaagaaaggaggagcagaaacaccaagaccagatgtcccttttcattcatctgtccagaaatttagcttttgtttggctgcaatttgcacatttgggcataccagtcaagctgagctccagatactcatttgtcttttagggtaacatggttagggaaatagttgtagagataggagctctcagtgaaaactcaataaatctgcttctgtcaattagggagactaagtagctttaacttccataaaaatctcaaaaataattgccctttaatgttcttttttttaagttttggagaactttagaggattatgttttgaatttagattagggaaacaaggacctgaggaatgatatacaagtttattaaacatgatggggtggaggggatgcttgatgatacccattatccccttttcttcatgcgccttagagagcctcccccactgacaggatgggcgtttgctgcatatcatatgattccttccccagtgaaatgctcgtcgagtgcttgctgtgtacccagcttattggtttggtgggctgcctacccaggccaatcaaatttattgtggaatgtttctttttggagtgaaggaagacagagggaaggagaggggagtagggggaagtgcatttatgtagaggaagcagcatgtcctacgacggagtcctgatagtgtggcatgttctggaaatggtacagtatgttcattatggttggaacacacattctaggagaggaagagggactaaattgcactggccctggggaaattgagctaaatggataaaagtaggcattgagagctgttggtgatttatagcccatcagcaccatgatcacactcttcccgcttctcctgctcaccacctttgcaaccaactttcctctcactgtgctgattgtctctggtacagatttatgatttccagcctcagctcagtgctcaggatgacttttctttcccttttttattctttcagacttatttctaatcagctgctttcttcattattagtagtgactgttccaaactggaaccgctgttctcaggcagtcagccctacttatcccctcattttaaagtaataatttacctcccttctcatatttctaaggaaatagataatatctggcacatactccctcggcttgcctcccctccgtattcaaacttaccttcatcacattcatccttaccgtctttctttctcccccagaggcaagtgcatctatgaagccatcccctcctccagggctctggagcctgcctagcctgcctaatgctctgggaccttgctctgtttatcattgactctcattcctttcttaccacagtccctttccttccatcttataaacatttcccaatccccgttggcataaaaacaccactgttctcaagatactgcttgcttccccttgtttaagcaagagaggtagatggtctgagtatgtaggaacattggctgtgatgttgaggggtgagtcagggaaggcagaaattagagagaaaagaccagttaggagggtgtcgaattaaggtgatggtgatggagaggagacaagtttgaaaggcatctaggaggtaggattaattacaatttgacattcagtgattatgagagttgaaagaatgatgattcttgtgaattgagaaagtacagaatgaggaggtgcacatgtaccctaaaacttaaagtataataaaaaaaatgaggagcaggttttatggagacgatcatgagttcacgatcgtctggaagtgttgaggtgaactgctcttggacatctagttggagaaatcaggtaagcagttgaaagtatggggcatatgatgtataacttaagaaaaatattcgttatttagaaatggctttggtaattaaagatgtcttggtgtatcttgagttagtcttggataagatcccctagagatggagtgagaagagagcaaccctagagagtaacacaggaggtggaggaagaggaccctgtaaaggagcctgagaacaaatggcagaaagaaagagggcaaatatgaggtaaatttttgttagatggaggtttttgttagtttttttttttttcttggaacgctttgaggacaaggataattgtattgacagcttctagcaaaaccagcctaagttgtatatacccaataactatgtattacattgcattattgacagggcttaattaaaataaagtctcatcacttgttgagaacttcctttgcctgaaatcacatatagctagggtttttggaaggaatgaggttgtaaatgagacagtttggaaaggtaaaatatcaatatattggagctatatggcaaagctgatggttagggggtgccatcgctgcggcagccacaggatgttattttcagtataaacctctttgctgattgaggtgattttgattgctgtcaggtgtgagagaataatcattggctgctagcagttttgccactgaagttgggggttcacagatctgaacattttcttgtactttaaatctccataatgttttatcacatttgaattccattgcaaccctccagtgatgagtcagaattaaaagctgttctaaactagattatattcttatgtttctacaaacaatcttcttaagggcagggatagaaattagagcaatcaaataattcatccaaagccactgagggcatggtttggcctcacattagctatggcccacttagggtctccatgggtgggggtgagagtggaggggctggtgcctcaggagctgtgcaaggttacccataggaggtgtgcaaagtcttaaaacttctatttataagcaattttatcctattcttaacaactatttttgtatatgtttaaaaatgtgcattagatattagtatagtgctccatgcttgtaggtatatatatctatatatatatgatttacataaatatggcagaagcatgctctaacattttgaaattgacaagtgtgtgtttgattaaaaaaaaatactttggagacctcaagattaaattgtgattactgtttgagcattgtaaattaactgggaatatttagaagtttcttaacaaacttgtgtcaatcattttagctattattagatttccagtaatagctaaacctttgtgttttagttgcaaaatgcagatgtgtttcttgaccttaattccttactatggattttaatggagagccttaaaacacaagttgaaaaccgtttgttgtactttttgtgaatatgctgaagttttctcatgaactaactaatgcctctccacatacggtatgttctttgcagtcattctttagtcacaggcagtttaagctgttaaatagtatcttgctttgaaaggtaggcggatggcatttctatcttctggtacatctggtaagttaatatatacagtctctgagtatcctgcagggacctgtttttacatgcatacagggatgtttatgtagaaatcaaaggccatgaatcagaagaacacaactcttgtttccagtgtactggaggcttgaaaaaattggctttgaaaaattgaaagtagtgtggtttgtttttattgtggaaccgatcaggaagaacaatttacagtcattgccattcttcacagatgaatggagtagaggtgcctgcctcgtgaaatggagcagctgcgcccgttttctctgggctcacaaaaacatttgctttttaatcgagaactttagatggtagggtacagtttgttttcatgatggaagtggtcagttgtgccttaccagacagctgtagtgtaattaagaaaaactgtgtgaaagtggattagatataacacaagaagccttttttatttttttttaaagaggggtttccccttaaatttattcatttttttctttaatggttcaaaggagaaatactgctatcattctggtccacaagatttttgctacttcaggatatcatttagctctaggaaacatgagatgctctgctatagaataattgcttgtttttgtaacaagtgcaaactaaaaactacaggttttaaagatgatttagtttgtgagagatttgccttcaaaacaaagcttaaaataaagaattgcacagttatatttacattaactttaatgcattttaaaaagtgacctacttttataataaagttgtgaggctgctttttagacctgctttgtacacaagttgcaacattaggggatctttaaaaactgttagggtattagctttttaagaccagaaaccatgagaggagaaaattatacttttcttgataaattttaaaatgagttagtcaaataataatgaaataagctgttgaagtgttgatgtagctaaatgtgcaacattaggctgtcaatttactttgaagagcatacacttactttatgcagcagactttgaaataagaatagaaatgccttaatttgcatcacagtctacagtagcaaaatgactttcaaggtcagagggagcttaatttctaaaaaaaaacacaataacaaaaccaaacaggaacctattgtgttcacaaataaccaagatttatttgtactagacacttaacctttataactttttatacagattgcccaacacactagaaaccaaacttttcatcctaagcaaagtaaaggtgccagtttcaggtttgctttaaaacatttttatatgttgattttctggaggagactcttaggctttatttcagttaggggaatttggaaggctggttgaagggaggaggtgagtgaggagttacagcccaaatgctcttaccatttccagccttgcagccctgccctgggaggtattataaggaggacgagtctatattagattggttggtttagagaagaaccctggctgctgtttctctctggctcactgatggcggctctctactgatttcttttgtctctcctcaccacagaccctaagaaaacactgagaatcaggccatccattctaaatggcaaaccatggctgcagcttgatagctggtgctttttctgtttgcaaactgagtcctcaggtgcaccaaaatcttcttcccctttctctgagcagcttctcaggcttagatgctactctgacttctcgacagacttctgcttctgtagaacatgagcaatgttgtttaggaaagaatggagcagagtgtggggtggattagaaaggtagagtaacaattaagaaactgaggcagtttttaaggtcagaacaataatgaagagcattgaaggtagatagcagcaggatgcagcaatagaattatgggacatgctaattactagaatcagaatcaaaaaatctggattaaagttccagctagcctagcgttgtgggaaagccattccctcactttctgtttcttcatgtatagagtggaacctgttctacataccaaacaagttgtaagtctcaaaaaagaaagagagagagcttgagaatgtgaaagtgttgtgaggtagtatagttatggaactgtttgacccatttatgtcctttttttgggaactcttgacaaccaaggaaagagaatacaagaaatattaaattttactaacatagattctttgtgagtgctcttaaagctgtttgataatcccactacttatctctgtttgattcccaacccactgctttctcataacaccaatttcaactcttgtcatccttctcaagccccaggcccagttccttctattttagtctcagtagataagttcttccccaattttgccaggaaggttgagcaaagcccttgagtttccctggccaccatctcaaaatgtatttcttcacttaatttccatctcactttctgtctcttcctcgcaaaggtaacctgtatccttatcacattctcatcccatttcttctctaacctttcttcatcaattatttcatgtctttctcttgttcttttaatctcctctaccggtccttcctcatagccaagaaaccctctttaagttcactgtcatatgtgtttcttccattttcactgccaaaattttccaaagactgatttgagctcattctttcttcaccattcatgctttcttttggtccatttcagtatggcttctgtctgttcaaataagcacatgaaaagatgctcagcatcggtagttattagggaaatgtaaattaatactgcaatgagatactacttgatatggtttggctgtgtctctacccaaatctcatcttgaactgtaatccccataatcatatgtgtcctgggagggacccagtgggaggtaattgaatcatgggggcagtttccaccatgctgttctcatgatagtgagtgagttctcatgagatttgatggttttataagtgtctggcattttccctgctgtctctcattctctttcctgccaccctttgaagaggtgccttccgccatgattgtaagtttcaagccctccccagccatgcagaactgtgagtcaattaaacctctataaattacccagtctcaggtatttcttcatagcagcatgagaatggactaatacactactacacccactagaaaggctaaaattacaaagactgaccataccaaatgttgatgaggatatggagaaattggaattgcacatattgctggtgggaatataaaatgttacagtcattttggaagtttggctgtttgtaaaggaggtaaacatatacctactatatgatgcagctattctacttctaggtatttactcaggagaaatgaaaaaatatactatgtgattccatttaaataaaaatctagaaaatgtgaacctatagtaatggatagcaaagtggttgcctgggaatgagtgtataatgttggaaaaatggattacaaagtaatacaaggaaacttttcaggggtgatggatcgttatgtaggttgtgatgatgccttcacaaatatatataaactcatcaaatttgatacttgaaaatgtgtaatttgttatacactataccaaaacaaaactattttaaaaaatcatagaactgcacactgaaaagggtgagttttatagtatgtaaattatccctcaataaacctgacttaaaaaacaaaacaaaacaagacatatggaaccaggcacagtggtatgcacttgtagttccagctacttgagaggctaaggcagaatgatcagttgagcccaggaattcgaaagcagcttgggcaacatggcaagaccccatctctagaaaagaaataaaaatatgaaaatgcaatcaatatggggaatgagagtgcaaaaagtaattgttaaacgctaatctcaaaatattgcatactttgtaaatccatttatatagtattctcaagtgacagggttatacagatagagagcagattagtggtagccaggtttagggatagtaaaccatggggaaaactaggtgacgggcacacaggaattttcagtgttgtttttgcaattatatgactaaagaatctgtatcacaaaaagtttcttttgaaaaggccttttagatattgtattctctaatgtgaaacaaagacagcatgccaaaaaataatcaatctttataattaaatctataataacggttactctgcaaacacttgaaactaaatttcatagagatgattacaatttaacattgtattgttgtagacagaaggcacaggaagaatcattttccaatttctgatcaccctatctaaatgttcaaaatcttaaattcgttttgactagataatacatataaatggctaaaaaatatatgaaaagtaatacactgaaaagccttcctccaacatctgtcatcgatccacacagttcttcctcctccaaaagtaaactactactgttcatcttttatgtattctttcagagtttatgtctacacgagcaaatgcaggtgtatctttttaccctcctccatgcttgtatgcaaaaggtagcttactataccaactcgttttgcgccatacttttttcacataacaatgtatcttaagacattttcaaggtggtatgcagctttttaattttttcttttgacagttagtattgtattatatgactgtaccatactttatttactgatctcctgtctagccatttagatcatttccagacttccgcttgtaaaaacaatactacaggctgggcgtggcggctcatccctgtaatcccagtactttgggtggctgaggcgggcaaatcacaaggccaggagttcaagaccagcctggccaacatggtgaaaccctatctctactaaaaatacaaaaaattagctgggcgtggtggtgggtgcctgtaatcccagctactcgggaggatgaggcaggagaatcgcctgaacccgggaggtggtggttgcagtgagctgagattgaaccaccgcactccagcctgggagacagtgtgagactccatctcaaaaaaaaaaaaaaaaaagaaaaactacagttaatattcttatatttatgtcatttcatacatgagcaaatatatatatatatatatatatatatatgtaattgccagtatttggctttttaacctagaaaaaaatttatgttgttcagtctaatatctgtagagtaaatgttcacatatgtaattctttgagacaaaatatttagcatccttttgattttctgatctacttccagatactcgtgatagtctggatgtttaaaatttgtaaaagggagtggggaacctttatttaaaagctccttttcaatatagttaagggggaaatacccatgtacacagggctatttctggaaatcctttaccagtaacttcattcagtaacatatctaactctaaccctgatctagctgtgttaggcttccttgcctgctagtgaaagcctttgctctccccttattaaaaggcctgaacataaaactctgagactgtttatccttcccaagtggggcattgcagaaaaatatcttcttattcgctatcagtgttactctctattgatcatcacaattattgcaactttaatattatgacattgtatgtcttatgcaatattaggttctctgaaaaaggctttttgtacatatgacaaataggtggagtatgctcttctacacagtgagccaaccagccgtcatcttggcttctccaaaactggttttgtgtgtgtgtgtgtgtgtgtgtgtgtgtgtgtgtgtgtgtgtgtgtgtgagagagagagagagagagagacagagagagagcgtaaatatggcaaagtttaacaactgatgaatataggtaaaggtgaacagtctagagtgttcatggtactgttctttcaaattttctgtagatttaaagtttttcttttttttctttctttcttttcttttttttttaaaggcaggtcttgtcacccatgctggagtgcaggggtgcgatcacagctcaatgcagtttcaaccttctgtgatcatccaatcttagcctcctgagcagctagggctacaggcgtgtgccaccacaattggctgattttttatatttttgtagagatgaggtctcgctctgttgcccaaagtagtttcaaattcatggcctcaagtgatcctcctaccttggcctcccaaagtgctgggattttaggtgtgagccaccacactcagcctaatgtttttcaaaagaaaaagttgagagcatattctttgttgagattatttattgtgaattaggggctgctgcttcgttacctattgtgttcttttttgttttgttttggtgtttctaggtttgaagacatcttagaaattccacttctaaataaaaataagaataaatgctaatagcaatttatacttattaagggtttcctctgtgccacacgttaggctaagcattttatatggatgatctcatgtaaacctcttatcagtctattattatcttcatcatttttcagatagggaaactcaggcacagtgaggttaaataatttgcctaaggtcacacagctatcatatggtagaaatgctacttgccaccatttctatctctatatttctgtacttcacctaggtttcatttgccctggtctttattttcctctgaagtattttgaagtgagagataggttatcctctggctcaaatttttaaagaattaacctaatccagataataggatgatgtgaaggcctcatgaaaacataaaaattgatataaacaggaagaaaaatcttttttttaaaaagagatagtctagctctgtcacccaggctagagtgcagtactacaatcatagctgacttcctgggctcaagcagtcctcccttttcagcctccccaagtagctgggactacaggtgttcatcaccacatccagctaattaacaacaaaaaaagtttctacagatggagtctcactatgttccccagtctggtctcgaaatcttggccttaagtgatcctcccactttgttttcccaaagtactaagaccatccttccactttaaagtactgaaattacaggcatgagccaccatgcccagccccgtttttttcctcttcattttcttttcctttatttcctttattttactttatttatttatttttgagacagggtctcactctgccatccaggctgaagtgcagtggcacaatctcagctcactgcaacctccacctcctgtgctcaagggatcttcccacctcagcctctagaatagctgggactacaggtgcacaccaccacacctggctaatttttgtatttttgtagagacgggattttaccatgttgcccaggctggtctcaaactcttgaactcaagcgatccgccagcctctgcctcccagagtgtcaggataacagacataagccactgtgcccggcccaagtttcttaatatattaatttgccaagctctacaaacaagaactgctttgtgtacatacagtagtcaaaacttgctggtcccttttctgagtttgcttatttgtttatacactgactggcctgccaaggggcattattgttctttttctgtatatttcctgtacatttccctctctgttgactctttgctttcagaacttaaacaggttccagtgttcctgtcttaacaaccattgccatttactacacacatcctctaaccacccccatctctcttcttcaaactaagctctcctcataaacaattcctatgagagaccataggggtatttccccatttcctgctggctcctctgtccctcccaactacccccacagactgtgctcccagtgacctcctttccttctagcaattttcctatgctattcttttatttacaaaactggaactgtattttatgcacagatattttatagcttgatttttttcctactttaatattagggactttctttttccaagtcattaatttttaaaaactttctattgatgaatagcatacatgcagaaacatgcacaaacgataagtttgataacctttcacaaaatgtcgttagcgtccaaatcaaggaaaagaaattgcagaatcctagaatctcctcccaacccactcctttcagtcacttcatccaacttccaaagcaatcctgacttctaacagcacagattgttttacatatatgaaatgtatgtaaatagaatcatatagtgtgtaccttttctgtgtctcacttctttcactaaagattatgatgtttgtgagattcatccatattgttccatgcacttgtagtttgttattctcactgttatatgatattatattgtgtgtttatgcattaatatgttttaaaacataatgttaattcctatgtaatattccattgtagggataattaattaacttattaattacccatcatttttgccaggttttcactattagaaataacactataataaacatctttctgtaaatacttgaagaaatttctgatcattccttagaataaatcctggaagtggatttaccagctaaaagcttatacattcttcaaaagttcttgatacatattgccaaattgccttctagaaagcttatacctgtttactttcctgctggcacagtacctgacacataaacattcaataacattttgtttacatgaactggatgaactaaattcttttatatcttagaatcctagaagctgagttttctgtgtctttgatctgccttctttccagttcatttttgttttaatgaatttatactaaaaacaatttaatagtacatagggcgcagcttcccctcccgaccttattctttttcaaaaataatctggttattcttgctcctctttcttttttttttagtggaaatttaaaatatactgctgcattctggaaaaatcactggagatcttatgaaattgcattgctggcattttctttacattaatgtggaaaaaaatgtcatatttatatgtttataatcctatccagaaatgattctccatttatttaattattttttatgaaatgcatttcagtaaagttttataggtttattgttgcagtaaagtttgatagctttattcttaaaatttaaaaattttatttgtgaatattttatattttgtgactactgggaatgagatattttgtttccattataatttcgttatgtgaaagctattgtatcttctatattaattttgtattcatcctttttagcaagctcttattaatgttaacagtttttcccttataatacttttgggtctgtgaacatttaatttataatttcagagagggagaaattaatatgtagaataaagaaatagaaaaatggtaaccttgaaaaaattaaaaaatagaaatgtagaattctgatctgttcttttaatgcattgaggtactcatttttatcagttctcaactattttctctagctttgtattttgaatgaagcagcaagtcacaaagttaaacataaaactaatgaagttgtagaatgtaaaaataatctatcattacgttaggaaaagtagttacgaaaaccacattatttacccattatactactctatactttttccattctcttatttttaaaaacttctctttttattatctgttctctattttgcttctctgttttgtttttttaagaatacaatagcttgggaataatttttttaaatactaatggaaaataaactttaggataaataagggaaaaaataaaaatctttcagttttcctctcggatttttttctcacgtattctcatatacttttctgttcttttggatcactttagtgattctcttccttcttacagcatgtattcatctgaatgccttcatacatgcgtgcatgtaagataccagtatttgtgtcaggggttgtcttatctcatctttttcctcagagataagaaaatgtgtctaagtcgtgtgtctacatgctattgcatagataataaaataattttttatcagtttactttcaatttttaaaattttttttattttcttttttattcattttaaattgtagggttatttttttgtttaatcctaaagatagttttaagtacctgtaaacttgaaccacaaatgtaatcagaaaataatactttaatcctagttaatccacgttattgaccgtctgtgcctacaagccgaaacaatagcagaatgtcttgtgtataacctctctcttttttttttttttttttttgagacggagtctctttctgtcacccaggttggagtgcagtggcgtgatcttgactcactgcaacctctgagttcgagcgattctcctgcctcagcctcccaaatagctgggactacagatgcacgccaccacacccagctaatattttttgtattttttatacagacagggttttgccatgttggccaggctggtcttgaacgcctgacttcaggtaatctgcctccctcagcctcccaaagcactgggattacaggcatgaggcatcgtgcccaacctagtgtataatctgttatgtggacctacatactcactggcaaagtctgatctagagattaactgtcttcttttgagatggtggttttgctgatttttaggaagagactatctagggtctcatttaatccttgtaagagacaggctggttgcacccatcttgtctaagtttgtaaaatgaaactaggtcagatcaattacagatagttgtaacttcctcagaatagtctgtaagccagggctgttggttattaaaatacattttttctcttatcaaaatcaaaggaattaattatttctcatgactgtagaattggaatatgacaacttgagaatcctatcttttgtagaatagaatagaagttgtttttttttttttttctaaaagagaaattcagatgctgcacggtttgtgtctttgggtgtttgctgagctacgaggctgggaagtgagaatcagaatggacaatcaggacactgtattcagatttcacttataaaatgggtttggaaatgaggatgaagggcactagccaaaataatctcaaaggctgcttccaggtcttaactaccaagatttgtagcttaaaaacgaactattgggaattatagaggtaaactgatgtgctttcattagagaggcgtaaaactggttctaagtccttaaaagaaagtagaaacaaagcaccaaagccagaaacaattacaccagcagaatacttaaaaactaacaacaaaaaactgttttcataggcaccctgttatacgcggtaatgcagtttgttttgtacaatgttataaaatgatcagtatactgtacttctggttaagcaaaataagaccaaagactgacacggtatgctgtctactctaattcagtacattcaccaaaaggagatgaaattaaagatgaagaagaaattaaagaattaaggaagaaattaaagatgataaatggatccagtttgcctatggcaaactgatagtatgccattctgaaggtggatattgcttatgaagaaaattttgagtgaattgtttccttttataattgtattagaagaagtgtggatcttgactgtagacagactttagtttaaatatggctctgctatttaggagttttgtgacactgggaactttttaaactctcttttgttatttgcttcacttattaaatcagcaaaatcattcctacttaataaagttattggaaagagcttattataaggagtttgtcccctttcatgaaattttcaaggaaattgtgatttccatgacttaaaattttctacttaaaatctctgttttttttttttttttgagacagagtcttgctctgtcacccaggctggagtgcagtggtgctaccttggctcactgcaagctccgcctcccgggttcacgcccttctcctgcctcagcctcccgagtagctggggctacaggcacctgccaccatgcccggctaattttttgtattttttttttttttaagtagagatgaggtttcactgtgttagccaggatggtctcgatcttctgacctcgtgatccgccctcctcggcgtcccagagtgctgggattacaggcgtgagccaccgtgcccggcctacttaaaatcttttgaggaaaagtgctatatcagaaaataaacaagaccaacccagttacatattaccatatcatctgaatatgttttacattagcttctgcccttccttctttttttttttttttttttttttgagacggagtcttgctgtgtcgcccaggctggagtgcagtggcgcgatctcggctcgctgcaggctccgccccctggggttcacgccattctcctgcctcagcctcccgagtagctgggactacaggcgcccgccacctcgcccggctaattttttgtatttttagtagagacggggtttcaccgtgtccttccttcttagaaaggttccctaattgtctgaactgtgttggagatttcgtggcatgtgtagtatttgtggagaacttttcctgtatggtcatttccaagtgtctaaagaatctggtatcagtccttcagattttagcgggttaagagaaaaagacaccaataaatcaagtaggcatagaattttgtataagaagtgaatctgggtatggtaaaaagttgtgatagaatgaaaactttctgaacagtggtttgggagaaatgcagtaagacttttaagaagtcaatcattcatttactcattgaatatttcttcaatattgattgtgtgttcagtggaaagaggtgacatggaatggggaagaatgttcaagacacacagagtagcacacctgaacggaagcagatttgaggatctgaaagttgttttatgattggagtgtagagttggaaccgaagggatgaaaagggatgagagagttagtcaggggaccgatcatcctggacttacaagccatgaaaaggaatttgacctttatcctaagcacaataggggccataaaataattgtgggatggggcaaaggccaggtctgtgttaagaaagagtaggagaatggattgaaggaaggagaacaagtagaggaagggagattgattgcgtggccgcttgtggaaatcacagaaatcatggtagcctaaacttgagtagagtcagtggctttagaaagctgaacgtggaggccagcatacaaaagagccagctagctgactgacatgatgtggggagtgagggaggaagaggaagcagggcaattggtgatgctttttcttccttgacacaaagagtacctaggaggagaaggtgaaaggggtaaaggattagttccattttagttggtgggttaaaggaacttgtgagatgtatctatcaatatatttatctgtgtacctatctgtatatcatattcatgtattctaatcatcctaactactcctctcatttattttttattttgaaataatttcaaacttaaaaggtcacaaaaacagtacaaagtgctttttgtttttttggaatcttttgagagtaaattgacaatatgatgtctcattactttccaatacctgagtgtgcatttcataaaagcaagggcatctcctacatttacgttttgtcccagtgatgtcctttacagcaaaaggatccagtctagaatcacatgttgcatttactcgggatgtctctttaatttccctccatcttgaatggttcctcagtgtttccatgaccttcaatatctagacatttttgaaaatcacaagctaattattttgtaaaatatccctcaatttgagtttgtctgacatgttttgcaattagatgcaggttatgattcaggaatttttgctaggaatatcacaataattatgtgttcttttcattgcagtctatcaggtggtgcacagctcctgttcgttacattactgaaaatgtcaaccatcatcatttactaattttgctatgagatggggaggtagatgcgtagtgtacagatcagctgatggtttacagaagagtaaacattcagaattccctcccaccccccgtaagccttgttcagagaaatattttttacataataactgtagtctttactgttattataatttggattattgcccactgaatttattatcagtttagtgcagaagagaaatactttgctcttgccttagattgaaaggctctccctgttgccactgtgctctggtttccagatgccttgctctcactgggattgatgtgctttctcacagagtgaagagagaacctgacagccataggaggaggaaggtttgcctcactttaagtccggatgtggttaaagcatgggagtgggagaagagaagggatttgactgagacaagttgatttgagtgaagccgctactcttagacaactttgcgtaaaacagctggttagttaatatgtttctcttttattccatgctagtcctccaagccttaaaacaacttattagagattagaatttttaaaatctgttttgcaataaggcacgtgtccagttgaattctaatttcactaaacctgccccctagaaaactgctgaacttatttgaaaacactgagtcatgatgatataaatatatgatggggatttaatgaagtaggtctaatttcaagaatatctaatttatgaaaccaagcagtactgtggaatttgttggtaattagaaatacaggtttaaagtatataaaccatatatgattttcataactttaaaggagtaaatgtttttactctttaaccagtcttgatattagtgattccttctttacaaactgaaatgactccagattttttgaaacagtactgttgtttttagaggaattaaaaaatatattgcaagtttgctgccatgtgtttctagtatagtactgctttgaaaatataggtgtttaaaattaatcaaatacatattagcaacctttaaaatacagcattgaatacaatatgataaataaaattactttatcaaaactcctttggagtctcagccaacttttatatttcatgttatttacctcaaactccattgtaactatgcagaacccagtaaaatctcttttctttctcctttctcccatattgtcttgtctacagaataccagagacctatcagttttcctaatgcagcttcaaaggcactattgactccttgccctgtttcttctacccttgcaaacttctgggaagtatttccaagtatcttatagctgagctaccctgtccttattgtagaaatcccatccaaatttcacattagggttatgattgtagatctctccttaagccttttgttcagcttctgcctttcacccaggtcaaagtgctattaataagcttatttcctattaccaaagtgtatcatcttaaatttccttcacctaacctatagcttcatcagaaacttaaatttttctgagactattgccaccctctcttgatcataccatgtttgccgcaatgcaccagtcgggaaacagccgtttagtcagagcctacttggtgccagtcactttaccagatgctgagaatactgtggcaaataaacacattattgtcctcatggaactgatagtctggtgggaacaacaactattaaacaaggtagtgcgtgtaattaagtgattgcatatgtgtgaagtggtttggagaagaaggagaacgtatgacttgtaaagcagacatgcgttttattggggtagtcttgaggtagttgtgttgaagctgaagcatgaagattgagtacatattgttagctggttgaaatctgggttggggaatattttaggctaagagtggtcccttctctatcatcacattttactctgtaatcaagcaggttctcatactatttattctcatactatttagccgtgccacttgctcactgtcacccagtgcttcttctttcttaatgagctcttgcttttatacctttctatatttctgattttatagtatcatcctattttggaattcctgaggtcagagttttcaagctgttagattaggatctaccagtagcaggctctcagtgtctgatttgtccactgcttcctacctggtgactctccttttccttctctcaactcctcagattttctgtgatttctgcaggaagcaaagccagcagtcaggtaaaggggttggggagttggtgggggtggggacttagaatatttgttgatatcaaacctctccccaccaaacacttgaatttcattttcagcaacctcttcttcccattctagtgacatcaagacttaagaagattgaaaaatgtcccatcttcagaggaaatctaggtattttgctctagatcattaaaggttacacatattcgccctgaaattctccataatctgtaactgtgcttcatctgttgcctaatactttatattttaaatttcttcatttacttaaaaatttctatttttgtaactagcagtttacatttttttagagtcaagcatattgatatgcagtatcactaacattgtcagtactggtgatatacatacaagcaaacttgcagatatatatcaacaaaaacaacattattgtactagtacaaagtggtcaaagtgtgttcctctgacactggttattatttttttgctgcaaggcatagtagctgggcaggtggtcaaactatttcttgtagccaggtagtaaggctttttattgagccgtaaccaattctatggctgagagaaaaaaaacacatttccctcgcatgactttccttttccctttaaatacctatttattaaaataacaatgtgaatatggagtagagacttattataacatctgtatgaaaacaattgttagaacaaaactaaaattgaaaaagtaccaatttattgttttaaatagagaaaaacatcttatttctttaattttttaattactagtaataaaaccaatgtaatatttgccatcttaaactatttttgagtatatagtttatttgtggtaagtacattctcattgttgtacaacagatctctagaactaaaactgaaactctgtactcgttaaacaaaataccccttctcccctccccacagaccctggaaaccaccattctgttttctgtctgtatgaatgtgactactttaggtatgtcatataagtagcatcatacagtatttgtcttgtgactggcttattttacttagcaatgtcttcaagtttcatccatgttgtagcatgtatcaatttccccttaaagctaaataatattctactgtatgtttatactacatttttttaattcattcatctgtcagtgaagactagggttgcttccaccattggccatcgtgcatggtgctactgtgaacatgggtgtatgttcagatatttctttgagactctgctttcggttcctttgggaacatttacttagtgagccccaatcttcttacagagttatttattttttacgtattagaatgtgggcggaattgatgaagggaaggaggcgatagtgactgtaaaaagtaggcagataatagtctgtccattgtttaaggctctctgtctgcttcagtgtttctcaaagtgttgtccatgtaccacttgcattagaatatctgggatattttgattcttaggcctttcaccagacttttcaagtcagactctcttgtgagactcaggaatttgcaccccaggggattcttgtgtacaccggaatgtgagatgcattgccctactggtaactagacatcccaggatttatctgtgtttatgcggatgaaaactctgttccctgctactaatagcaccttgcttttggggggcacatccatcccatgccagcctatgattttcactttattctgtctgcgtattgtagcccaactaaaagtctcataaatgtagtaaaggagggcagccctgagttcataaccctaaacttggattcaggcccattcaggcccttcttctcaggctcctaatggtgattcactattgctgtgtctgcttctgatcagtgggccagtgaacaggttagaacttcctccctctggccttgtagtgtttaggcttacctgagttcttaaagggaccaaatctctttcctgatacgaacactttaagtatggcatagcaaattgtgatcctaattaaggcagtaatttctcacgttcatcttgtatagctgaatgacatgtgtgacatctttaataaaaccaaccagcttctgcattctgaaactgaactctgtcttcatctagttatcacattgtgctatctctaacatgtgttcttggcttctgattattacatgatctgtgatttgcaagtgactgtttttcattttttgtttttttgatacagaatcttgcttgctctgctgtccaggctggggtgcaatggtgcgatcttggctcactgcaacctccgcctcccgggctcaagcactcctcctgtctcagcccccaagtagctgggaccagaggcccacaccaccacacctctaatttttgtatttttagtagacatggggtttcaccatgttggccaggctggtctcgaactccccacctcaggtgatgcacccgcctcagcctcccaaagtgctgggattacaggcaagagtcactgtgcccagctggagcatattttattttctatttacatatttaggctttaagctgtacacaccaaaaatatttttttatggcagtcctgtttgttctcagcagagcctgtagagcctgttgtcagtggaatgctgagaacagccctttgtagagctttctattggcagtattttgggattcaggctgaggaatggttgacccaacttatacttccagcagtatgtaaatttactctgacatgggaaagatattaacagcagcaacaacacaaaatctttcaagatgcagatttgtacagcataatacagtattgtacaaatgtacatatacaaaattaatttggccttttcagtttctagtcttccagcctggaagtaagaattgtttttaacaaagtgttaaacggctaaattgatgttttggggttccgtcaagatcttccagaaaaattattaccccatagctacaaagtaacaagactgagaactaaggacatcagtgaagcccaagacaagttaattaagagcagaccggtaggactgaccggtggatatgacctcatttagatttgttggtgttcttactttccagattaagcatgcttaactattcagtgtggcccaatgcttttaaagtagtaagcatgtttttgagctgtatgattcgaacagcaatcacatttaaaatctaacatggtgcctaaaagttgtatagaaatatgtatgaaaattcacactaatatattttaacgtagactacctgttctggtgaactcttagtttgaaactttctttatattttagcaatcgtttgtaattctttttattagctcttagtgagtgtgtatgcagcattttctttcttactgtccttctcccacctacagtcaaatcaacagatgtttattgagcattcactttgcatgtgccaattctttcctttgccaatttcgggtgttaataattttggtatgctaatttattacatgctctgtgccattttaatttgcttttctttaattcacagtcagcttgtaccctttcctatatttgtttgctaactgcattccttcctctatggcttagctgttcctgttcttggctcattttcctttgaggttataacagttgtcaacagaatcctgaccaggctcctgggcaagccatgtcttaaccaattagtacttttgttttctctctattcctcttttcttcattatggtggaaaacagacagggattaaatggacagaattagaaaaagtaggaggggaaactaaactgaattggaagagatttaaatgtaatgtgtttaaaactgaattggttaacttaactcaagctttgataagtaatgggaagcaccatgatattatggaataatttgtcattttcaacagacttgggttttagtaccaggtctgcctctgttacatgaatgcaataaagcctacctcacaatgctgccagagcatttaataagattacatgtacgggccttcccctcccatcctctctgtcttagtttgtttggactgctataacaaaataccataaaccgcgtggcttacaaacaacagaaatttatttctcgcagttctggaagttgagaagtccaagatcaagatgctggcaggtttggagtctggtgagggcgcactttttggttcgtagaaggcatcttcttgcttcattttcacatggcagaaggggacagcccagctctcttcaaccccttctaagggcactaatcactcgtgagggctccatcctcatgacctcatgacctcccaaaggctccacctcttactaccaacacactggggattaggtttcaatatacgaattttgcagggatcggggaggacacacactttcagtccatagattctctgatgctgaacgagcgtgtcgctaattgctacacgcaaagacagaatagcagtcgaaaccaagaccttaccccggcttcccatccttctctgcaattagtgtctaatatgttttcccatttaatctttataacagccttagtatgtatcattattcccatttttcagatgaggaaattgaggcactgagaagtaacttgtacaaggtcatagatttggtagaggatttgggtagagttctgtcagatttcaaatccattctctttccacagtgccaggctgcctagaataatgagtgtgactgaagaatgaaaaggagttaatggtgtggccattcccctgttctttccactacttcacttggtgaatgactaataggcaaacactcccagagggtatttgcattttaaaagcgagctcattaaccctaatgaatctctaattggtggaatttgtgggggagatatttttaagtactggggctttctcctgtgtcttcaaggtgcctggctatctttttcttctttataggttatcaactattctggaatcagaatcgtgtagcagaatgcagtcacatactgctagtctgccccaaatgcattaacagggagtcatgaattaaaaggcagccatgaaaaaacattgaaaggaaaaaagtgtgggttagcattgtctaaaatgaatgtccaaaagcaaataaatttggccatatagagagtcttccgaagagtcagatgaaaagaatatattttataaccaaatttaactttagaaatgttatatcagcatttcccatggtgtgttaatgaagctctgcaagatgtttaataggtgtcagatgaataaaatggctccacagtcaaatacacttcgaaaaaaaatttttttttaagtttcatcactgcagaatttcttagatgctaaagtgcattaggaaatcaactggaagagaacttgcattctgaaggtttttctcatatttttgaccatagaaatatttttttccatgtgaaccccttggaaccagtgtttcatagattgcattctcagatacagagttctagataaatcatctttaattaaagaaaagaaaaagaaaaacagttttctgtattcacagccctttgcatgcagacaggctccaacccagtccacaacagcccatttccagtcttgttgggctcaagggcatgccaataataacagccctcttccccagatgagatctggccaattgaggggaggaaaaaggaacagatggagaccaaactctcatctttattgcctataaagctggtgttgaagaatgtggcttataacagggagcaaaagggcgtcctaatcggaatcccagaattaggttgagtgtgtaaaccaaaagtaagatcctaaacccccacaacagactgaacggaccccctctgggcctcaaaaactgaattccccattatgacaggagagatcttggtataccccctcccttttggagtttaggagcaactgactagcattaatgttaaaagagagattataagactgacaaaacagactctttgtagcagtaagataccaaattgcaacctgacactggtataggacctcatgacagatagcagaccctgaaggaaataaaaatattttaccctagaatatatttccttgacatacgttgaaatggccctgcaaagctgtcttttgtgggggagattacatccgtagagaatctccttccctttctagatctttcccagatctaggagagatgaaatgaaaggctgacacctttaaggtctgaagagagacgcttaggatattctctatagggctgttacctgaaggcgtcatctacttaacaagaaccttggcttccacaatgccctttttcttaactcaagcatttacttctagtctttagacaaagctgaactccttcaaccaactgccaatcagaaaatctttgaatccaactatgacttgtaagaacccctactttgagatatcccaactttttaggctgaaccaatatataccttacatgtattgacttatgtctttgcctgtaatttctttctctctaaaatatataaaaccaaactgtaacctgaccgtctcaggcacactttctcaggacctcctgagactgtttcctgggtcatggacacacacattggatccgaataaacctctccaaatattttacagagcttggcttttttgtcagctagttccactcagttacagaatatgctgagctggtcaggcttttccccaagtgggaggatgtttctgtggaggatcagagcagacagcaacatgctgcctgtgttccttgattcttaagagagagggaaggagaagttactggaaaggaatcctgatcttggggagggttcttagatctcctgcaagaaagaatttggggtgagtccacagagtgaagaaagaaactttattaagcaagtaaaggagtaaaagaatggctgccccacaggcagagcagctgcgagggctgctggttggctatttttatggttatttattgattatatgctaaacaaggatgggttattcatgagtttttaaggaaaggggcagggatttcccagagctgagggtttctcttccttttagaccttatagggtaacttctggatgttgtgtaaacagtcatgacgttggtgggagtattgtttagcaggccaatacattataattggcatataatgaacattgaggatgaccagaggccactttcatcaccattttggttttggcttccttctttactgcatcttcatttatcagcagggtgtttgtgatgtttatcttgtgacctcatatcccatcctgtgactaagaatgtctaacctcctggggatgtggcccagcaggtctaagcctcattttatccagatcctattcaagatagagtcactggttcaaaggcctctgacaaggggacagaaccacttgtggccaagtcctcccaaatgcaacaaccagtggacaggagagtggagagaggcctggagtgaatgttaatggaatttcctccatgttgaaggaagcataaggcaagtgacctcacagggttaacaggaattctgaacagaaatatatagatatacttaagcattcttctggctgtactttgacccatttctattttctttcttttttttttttttttttttttttgagatggagtttcgctcttcttgcccaggctggagtgcaatggcataatctcggctcaccacaacctccgcctcccaggttcaagtgattctcctgcttcagcctcccgagtagctgggattacaggcgtgccctaccgcacccggctaattttgcatttttattagagacggagtttctccatgttggacaggctggtttcgaactcccaacctcaggtgatccgcctgcctcggcctcccaaagtgttgggattacaggcgtgagccaccgtgcccggccgacccatttctttgtaaccaaaatttatgtaacaccagatactgaccatttgtatccccattgttcctatagataggattctggttttcgttcaagatagtgtccctgacactagaatcataagctcttggtgaagaattacttaagcagatcctggattctagtggaacaactaacaccaaccagtttaaagacccccacagaggaaccaaatcagcaagagaataccgtttcttcatctccctgccccatgacttcaccccacaattttcaaccaatcagtggtctccacactttggcccactccaaaacccttaaaaaccctacccccaaactcctctggggaaaagatttgagctttcttcatgtctcctcatttggtggccctaagattaaagttctttttctgctgcagcccagtgtctcagtgtattagtctgtttatgttgctataaaggaatacctgagaagggtaatttataaagaaaagaggtttattttgcctcagggttctgcaggctctacaggaagcatgatgctggcaactgcttctggtcagggccccaggaagcttacaatcatggcagaaggtgaagggaaaccagcatgtcacatggcaagagtggaagcaagagaaatgccagactcttaaacaaccacctctcacatggactaatagagtgagaactcattaccacagggagggtacttcatgagggatctgtccccatgacccaaacacctcccagcaggcccacctgcaacattcgaggttacatttcaacatgagttttggaggggacacacatccaaatcataccactcagtgtattgacttaccacatgcatgaacaatgaacctattatggttacattaaggagtgggaaccaagtgtctgccccatcacccacctaccaccaaccccttcagacaagcctcctctgggtgacctaagtaggtatttggttcttctcccatcactggaaatttctgtcctgtccaatttcctttatacatagtgctcactcttcagcattatttctcccctcaaccatcctcacccagtagaatgggatcatgatgatactctaatgaccattcctttctcacatccttatatagctaaaacatcatccaacatttttttttttttttgagacgaggtctcactctgttgcccaggctggagtgcagtggtgtgatcttggctgactgcaacctctgcctcccaggttcaagcaaatctcctgcctcagcctccccagtagctagggttacaggcacatgccaccacccccagctaatttttgtatttttgttagagatggtttcaccatgttggccaggctggtcttgaattccagacctcaagtgatccacctgcctgagcctcccaaagtgctgggattataggcgtgagccaccgtgcctggccatcattcaactttttatcccggaaatgatggaagacatatatttctctaatacagactggaaaactacaggctgccacttgtttttgtaaacaaaattttattggaacacagccacacacattaggttacatattttctatgactgcttgtgactacaatggtagagttgtgaagttgtgacagagaccttatgacctgcaaagactaaaatgtttactatctgaccctttacaaaaaaaatttgccaacccctcgtctaaaatatagatgagtttcacatcagtcctttaagttctgaaagagcttcattagtatgtatatgtagcctttatcatttactcactctaaataaaaactacatttgaaacaaagaaaatcgcatggctgtactataaggataatttttacatcttgtaaaattgtttccagccttaaaaacttcctgaaaaatatgaagggaactgtgtatttgctttgaaggagcagaaggaagaataaagtcttgcatcagtcagaagtatttgatgtcaccattgaaaagggaagaaaacagataatctatggggcctatagaagcaaaaaggagtaatgaaaactgtctgcaggaccagaaggcacaagatcctgccttcagagctccctatcagagcccttggctcctctcttcacaccctgttccctaactcagagtctagtttcctcccaccttggccctcatgcattggaaccgttcaccagaccacagagtccccagagatgtcaagagactgggttctgctcccattgtgactgctttctatgtgggagaccttgggcaggtcactgagtgcctctgccccttaggtttcactctcctgtaaattgggggtgggcagagttatcttactgtgcttgcccaacagtaatcaaatctgatgttttttaaaagcctatatgaaaggtaaggtattatgaaattgtcagtgtttttgtttttgttgaaatgtctgagttgcaaatgaaatttttttatctatccaagatataaattagagttaactgatatttgaaaacttaagtaccttatttcatatttctcatacccatttttgcttatttatttttatagtatttaacttttatatggattagagaaaatatagaaaataactgaatttttaccataataaaataattcttcaaggggtggaaaaaaaacttcaaaaattgtatttcattgtgacccattcttttctgtttgttgtttattcagctttcatttttatgcctttgtttacagagaaacaatcttgcagatggcaattttccttgtaatcatttattgtcctatctgagtcatcgccagacatggcatttcagtaaacagtgattctgcaattgcttccaggcagatgtgttgtgtgaagttaagaacgctggctgataacctttctggtttttcaagcagcagggagaaagttttgtgtagatacacacctcgaaatcagaaaatggcgaaggaaggactttgtgctgcatgattttaaccaaatatagtgtttgtgtgatggatggaatagtaatctttttaaaagataaataatatttcttcgagtaaaggactttttatagtgcgttatacgtattttcttagaaacatcgtgcatgtgcattgttaaacacaacgttgaccttgttgtacagacatttgtatcaccttgtccactcaggttcctgtggtctcatgcctgtagctaagcaaaccaaactcctcatgcattggtttttccagtgtaaattggaggttctcttatccctcactttcagacataggggatttcttttgcctcacaaatatgtttttacaaacacgtatgctcaaatataatttttattatgtatcataaagtcttatcttgtcactgtttttatctgagatggagtttcgctgttgttccccaggctggagtgcaatggcgcgttctcggctcactgcaacctccgcctcctgggttcaagtgattctcctgcctcagcctcctgagtagctgggattacaggcatgtgccaccatgtccagctaattttgtgtttttagtagagacggagtttcaccatgttggtctggctggtctcgatctcctgacctcaagtgatccacccaccttggcctcccaaagtggtgggattacaggtgtgagccaccatgcctggccttgtcacagttttaccatcaactacaaagagaagttcactaatttattcatctaatgtttattgaacacctattgtgtgctgggccctgcccaacaataataatgttgcacaaaacagagaacaaagtaatagggtggaatatgcattgtaaacattttgtgggttaatttatcttaaatatataagctaccaatttagttcttgtttcatgattttataatttaacaggcttataaatattttttattactttaatcactttttttttattgcaataggttttgggggaacagatggtgtttggtacatgagtaagttctttagtggtgatttctgagattttggtgcacccatcacctgagcggtgtacactatacccaaagtatagtcttttatccctcaccctctcccaccctttcccctgagtccccaaagtctaatgtatcattcttatcaacaggcttatattaaatccttcacaattttcatgagacttttccttgattatagccatgagtaaactaaacttttgtgttgcatatggagaaattaagcttagacaagattttcatactttatctccagtcaagactcatgacttttccttacattaacaaatttctaaccattagtgtcagctaagccatcatccatttctttggtaatcttccctgctgtggacattcctaagattgcccaattttatagaaaaagcaatttacaaatggctaaattagcgtctgattatgcttcaaagaagtaggctaataggtagtctctatcatgtgttaatcacaaaccattagtgataattaataaattaaaatgggccaattatgaaattctgcttatacttacccaagtgtgtttgtgtctatcctgtgtccttcaagccagcctactcaccaacttcatttagtaatgtaacccagtcaggcactagccttaggaatcaaagtattaagtgaaggctagtttatgcatttgttcattattctttcctgctgtaaggattatctgtcatctggttaattattacatataaacatacacatctactccaaggcaaatccacaaacgcttacaaagagtaagccttatgaaaaactaacttggaggacagttatccatatcataaaagagtttttatttcaacataatttgccttaagtcataagctttccaagtttgtttgaaatatgacttgatttataaaatatgaatttatttgatttttccagagtaaatctagataaaacaggatacatttaggttgtgtgtgtatgtatttatgaatgatatatgagacctgtttataattactgttcttaaaaagttagcttgtttactttgaaacaagggaaatagtggtttcttccatgatgtgaaacatataataacaaaagatacttcaaacaaatagcaagtagtttggcctcagtaatatggtcaagttttaaaaatagacatatattttacttcataggagatacaacagatgagcaaagaatgacagcaagaggcaaaacttcggacatagaggccaaccaacctttggaggtaagtgaaacagagtaagtccttttcggtgaaactgaacaagtcactatgattacttatgcctccgaggataaatagtaacttctgctcttgctatgccataggtgcctgaatacagggaaacaagtggtctgctgaaagtcagtggagagcagtacagggagtgccttcccaagtgctaaactcctttagtgctagaaatgaaaactttctgttaaaaacaaaacaaaacagaaatcaagtccttaagttaaaacatttaaactatttttaattgagtgattatgtactaatatatttcaataaataggcagtatattaacttgtagagaaaggcttaaaaataatccattcagccgggcacagtggctcacgcctgtaatcccagcactttgggaggcctaggcgggtagatcacgaggtcaagagatcaagaccatcctggccaacatggtgaaaccccatctctactaaaaatataaaaattagctgggcatggtggcatgtgcctgtcatcccagctacttgggaggctgaggcaggagactcgcttgaaccccggaggtggaggttgcagtgagcctagatcgcgcctctgcgctcctgcctggcgacagagcgagactccgtctcaaaaaaaaaaaaaaaaatccattcaaaatcccgttgccttactagttccagcatcaaagtacactccttgaaagtattctgtagaaaaactagggtatttattctttttcacatgagaaaactatttgctctctaagagtttacatgaaaatgtagttaggatacttttgaaaactatatagaaatatactaacattatttaatcaccaaaataatcatctttaagacttaaggggaatgttaagtactagggtggaaggattatcttgaaatgtgaaactttctacgtagtgacacacctctacctgtattctagttgtagcatatgagggtattgctgcatacaactagagggaggtcagagacctggccagtgtgattcaccatggttccctaatgcctagcccacagtaggtagttgaaaagatttgttaaatgaataagtcagtacaatcatgagtaataagtagagactaatatacttttaagagatatttttattttttatatttatatttttcaccgtgaacaaatattttgcaatcaaggaaaaatcatcctatttaaaacatcttatttaaagatgtgatataggaagtaaattcatgaggaggaagaaaatcatctttctcatgaaactgtgcattcattctttcacttatgcatgcaacaagtatttattacactgaccgtactcaagatactgtgcatggagctgaatatataatggtgaaaataggacacaaggacatagaaaaatgtccatcttatatgttgaagcaacttgatctctttcatttattcaaacatttggtgaggctgggcgtagtggcccatacctgtggtccctgtgctttgggaggccaaggaaagaggattgcttgaggctaggagtttgagaccggcctgggcaacattgagagactcatctctacaaaaaatttaaaaattagctgagtgtggtggcacatgcctgtagtcccagctactcagaaggctgaggtgggagaattgcttgagcccgggaattcaaggctcccagcctgggcagcagaaacatttagtgagtgctggccataagtagcatctctgataggaaataaaagttgatatgtttgggatttgggagataaccaccaggatggttcaaaaatcatccacaattacttgagtttcgttgcttagtgtcttcttttatatgggctgctacagcaaaataccataaattggataccttatgaacaacagaaatttatttctttagttctggaggctggaaaggccaaggtcaaggtgctggcagatttgtgtctggtgagggccctttttttttttggtttgcactctggctgtgtcctcacatgataaagggagaactctagtctcttcagccccttataagggcactaatcccattaatgcaggctctcccctcccaccccctaatacagtcgccttggggattaggtttcaacatacgaattttggagggacacaaagcattcagaccatagcacttagttatgtgattcattggaaatgtctgcagaacttgactatttttcaaagttgattcattgatagaaagaattccaagactaattcttaaggaaagatgcttttaagattacaatccacagagctttcaaacaagctcattattgtgctactttctagtctctctattaatatagtcagttgttaatcattaaggctggatgtacatactcatgcagtaacagatgtttcaaaagtgccttctatgcaagtaccggctgggcaatgagaggacagtgtttgctatcagacagctcactaatgtagaaaaaaagaaaagtggagtgggagactataaatgagaccacagggttaaatcgcaatgcaagaggaaaacaataaaatacttctagaggctatatatgttttgccacagaaaagccaaatagtaatttaccttgacagtaagcatctaacatgggatttgttattcctcccctttaaaatacaaaaatgagactgggcgtggtggctcacacctgtaatcccagcactttgggaagtcaaggtgggtggattgcctgagctccggagttcaagaccagcctgggcaacatgatgaaaccccatctctactaaaatacaaaaaattagccgggcttggcgccgtgcgcctgtaatcccagctactcaggaggctgaggcaggagaactgcttgaaactgggaggcggaggttgcagtgagccaagattgtgccactgcaccctagcctgagcaagagagcgagactccatctccaaaaataaaataaaatacaaaaatgaggccgggtgcggtggctcacgcctgtaatcccaacactttgggaggctgaggcagccggatcatgaggtcaggagatcaagaccattctggctaacatggtgaaaccctgtctctactaaaaatacaaaaaattagctgggcacggtggcctgcgcctgtagtcccagctgcttgggaggctgaggcaggagaattgcttgaacctgggaggcgggggttgcagtgagccgagatcacaccactgcactccagcctgggcgacagagcggaactccttctcaagaaaacaaaacaaaacaaaacaaaacaaaacaaaagtgaaaacactgctgaacgctcgctacccttcatatactacctagatatagtcaaaaatgagtcttatccagcctcctcgatttaaattctgtgtagaagttgatgactcctaaaatatgtctctacctagacctctcccctgagttctagactctgtacccaactgcctatgtaacatttcacttacaaatttctacacagttcagcctttccttaacccatagaagaactattgatacctggccccaccaccctggagcctctctgtgcccaagttttaatcattcctgtttaatatcaccaccctatatctatatagtgatttagaaccaattccccctgaggtacccttggctcctgtctttccctcacactgcacatccagtctatcagcaagtcctgccatcttgccctctatatccggaatgtgactgctgctcaacgtcatcactgttagaacagtctaagccaccccttttactagggccccattctttctcctccagcccattctccacatagcagacagaaatatgtcagatcacatcactccttggcttaaaagctctatctactgtaactagaataaatgctaagctccttgcagtgggctacaaggaactccatactctctctaatctcatttttctccccatccccatccaccagccacctgccgttctgtctcttgatgatgttaagccctttcctatctcaggctttgtatttgctagtcattttttaaaccagagcttcacttggcttcctccttatcattcaagtgtcacttttcatgactacctcagctaatgtgtccttcccccagtcactgtcacataactctgtcttattttctccattacacttaatcactatgtcggattattcatttgctatctgcttctcctgactagaatgaaaacaaactttgtatgtctagaatagtgtctggtacacagaagttacccaataagtacttgctaactgatcatctagattttatttaatgtctttgtccatctgccaggttaaaggcctaaatgtcattttgactccttcttctcactccctcattaaatctataaccaaggcctaatgtttctgcctatcaaatatcttccaaatgtggtttctcctacaccaactaggtcctcatctgttcactagactattattagatgagcagtttcttccccaaatctctttctaaaaaagaacagcagggtttttttttttttacttcccccctctaaaatcccttgaaacctgcacaatgcagctgaaaccttgaaccctgttctaatgtcacttcctttgtgaacccttttctctgctcccccagccagagacaaccccaatgtcctcttaatgcttagattgtcttttatgagttcactatagtgcaggtttttgaaaggcaggggctatagcttaattagctttatgacctcagcaactatcacactgttagacatatgtgatgtaacataaatgccctgtcaatgatttctgggtagataaatgaaaaataaataatccacttatctttattaaattctgttttctactttacataataaacagacagttgtatcttttctcaccataaaaaaattttcttgcatttctttggagttatccatttaaaaatctgttaatttacattatttttggcactcttactacattagcagggaaaagtttaataaattcagttagctttaaatatatatatacatctgattaagaaatcataactatttgctaactggaaagcctctaattattttaatttttaatgactaagcaatgttgaaatattctctataacgagaacataattagtaaattagcatgggttccataaagcttaaaaataacatttgtagttgccaaaatatagctcagttttctaagaacctttggagaaggtggcttttagtataccgaaagaggtttcttttggcaagttcagataaacatatagattgcctcttagtttcaagggattgtgttagacatggtggtagggaggatacaaagatacctaagacccagtgactctgacttactgatgcaggaattctccatctatttgtggaaaatttagcaaatcactgtactgtaaagtgaaataaaataagttccttacgcgtcataactacaaaggtagctgtgagatttcgatggaagaaggatattgtctgggggagtcaaaaaaggcatcatgcattagatgagctttaaactatgaataattttgtctacttgtatgattaattttttatgattaagaagttcctgggaaatgaaattcttcattaagaacattttagaaatacagaagcaaatcctaatgtgaaattgctttacacacgtgaatctcaatggctggtaataaggggttaaaaaatgaaatgaatgtagcgtggcctatgctacattgtaattttaatgacagttaaaatatttgttaagtgtctgtgatatttttcattacacgtcatagcccaagtatatttcaaaactgtgttctccattcaagtacatctctcgaccttatggaaattctaacatctagatggaatagaatttaaaaaagatctggtttgggcatcaaataggttagtttttacagagctagattatgggatattttagcgcatttacacgaatgattgtctatggaaaacagcgtatttgtattaagtaatttgagagactttgcagttcatgaaagtgatgataatttagcattcactccagaaaaatcgaaagttttcagtacttcctgaagtagtgtttgtctcttcttcacctccctgtttaggtagtttcaggtttctctcaataataaattaattaatactgcatctacatcatagtttcctatgtatcatcctaagatattatcacctaaaatagggtaactttaggagacacgtcactgaactatctaatcatcaaaatgtgatttttactaagttgtgcattactctgtgttttaagagtcatttgtaacttttaacaaagttcaccatgtttttggtatggagagagtgaatgtgtataaatccatgtttgggcttattaaaattaatgtcattagactctgatatttgagggaagagttacaattcaacctaattatccaattaaaggattagacacatccttttcattcttcttttttccttcttgcccttctgggtaaattttgatagtgagttgtaatgatgttgcatctacttctactgtgttctactagtcttggagcctgtaacttacagctcagggagataaacctgtaggggcccagttttgagtttttgccattatgactcatctcttaagagaataaacattacatgtaagcaagtcgtcattctttttcaatttgtagtcttggaaagtgttttatattgtgaaaactggaaccgtattagctaataatttaccagcggacctgttctttttggctttaaggtgtattttgggaatcgagaatgttagttttagtttttaatataactatgtctaattttggtgactgaattttaatctagttttagcagatatttttaggttgtttattttaagtgttggttgaacttaaatttcttgtatttgtaactgcagttttttaaaaatttgaacttatttttgatctcaaagactgagggatatttttatttacttatttttatttacttagtggcttaaagataataaaatacaaaaacaagccaataaaatgctccccacaaaaccataattccatttgtgtatttgtcttgagtgataacgaattcacatatgcatatggagacacatataaaataataactaacagatggtagagctgcaaagtaggatttataaagattattatcagctggtggtattgagatactcctgtggttatactgacagaagacacaaaaattatttatattaagaaactggcactaacaccttcccccaacttctgttaccaaagtaacttattgcatatttaatataaatttcttaatgaagaggtaaaacaatcttatggccaatttgtactagcaaatttaatagagtagcagaaatagtaattaaggtagtagcaataacaataaaaactgttttgctaaaattgttaggggcatgatatttctagtaggtaaaggaaggatttaagggactttgtttattcaggtaatttcaaacacacttctcaatttagtacacagcggtcactttggaatattgtacaattgtaaacaaaagcttgagttcttttgagctaggtatggaagctgcattgtatatgaagctgcattatagaattcatagttcagtaatttagggaaaagttgattcttttgttcatttctttttaaaaacttttatttttaatggacaagtaataattgcatgtatttatggggtacggtgtgatgttttgacacatgcttacaatgtgaaatgattaaatcaggctaattaacaaatctatccccttacgtgcttatcttttttcatggtaaaaacatttaaaatctcttttagcaattttgagtatacagtgtattgttatttattaaagtcaccattctgtgcattagattactaaagcttattcttcctgtcttactgagactttgtcccttttgatcagcatcttccctttccctacccactcccttccctcagcctaaaatttgattttctgaaaaaagtatgagatgcacattttaataaaacatgttcactcttcttctgatgtgttttcatacatccattatgtctttcatagagctataggagccttcagattctgtagggacgcgtttccttgttgcttttatttcagatagttattgaaatgaatgaaaatatccttgagatttgtgaatcccatgtgatacagactttggttactactcctcaaagaatggaataagattactgcattaaaaactgggttttgtgtagaaaggaattggggactcaaagtatagaaaaaaggagactggagggggagattttcaagaacaatttcaaaaatagcaacagttcttctagtggatgccaggatttcagttttaagaattttttagtacaaaatggtatataataagtatattaatttaaagcatcggggggttacaaagatgattatgaaactctttactcacacaagatattcatagtcaaaatacaaatataatggatattgctattgaaggcagtttaaattggtacaactattcttggagagcattttggcaataggtattaagagccataaagatgttaatatactttgacagtaattccacttttaggattctgttctaagaaaatagtcttttaaatccacaagttgtatgctaaaaaagatggcatattcagtcagtgcaatatttttcagtttttataaatgacactgatgatgagttttcaataaaatatacagatatagtacttaattttataattttagttaaaaatgcaatatacaaaattgtatatacagtatgattgctgctatataaaaactatgcagaaaaagatgatgtaatacataaaaacattaagagtacttgcatttgggatgatagctacataggttaaatcattctttccagtgttctgatcttccaatttgtctataatgaatgtatcttatattttaaatgatagtaatgttggtgatgaggaaacaacgtattcactcaaggatagtttttgcaagaactattttgtgtgatagtaaaatagtgaaacagtcggtctgttgagaatgatcatgaaggagatatgttggcactttgctcccttgactcatttaggtttaaggtctcttaattagttgatcacagagtaccacatctgaccacaatttgtcaaaacatctgtcccctgacacccagggacctttccagcagggagaagagtgaggtgatttgggaggttattcttcctatctctttggaaatcacatggcccaaacttttctcattaatcaacctgtcaatgtcattgaatcacttataaaggcatattttcccccgcaaaagtgtatgggttactggcttggacacatatttgtctaaacatctcgcttctttctttttatctatgatgctgagactcctaatttaaagatatgaatttctagctttatgataattagctgatgagaacataattttatcaaagacttgccaggatttttgttcattctttgtttttcctaatataaaaccctttctaatttctgatttctttggatatgaagcatagttagattattgcactgtgtcatttgaacagataaatttaattctttgatgtgtttatcctcttatgcagcataccttttggtaagaagattttgtagaatgcatttctccaacctttattttcatctgaattgctgggtcatataacaaaatagaaagtgcacttttgttggactccttagctcactaagtatgatctaggatatgttgctgagatttcttcaacttcaattcttagtccatgaagtcgatgaattaggtgcaatgtttgagcgccctccctgcccagaagtcatgactgtttacctctttggaaagcgaactggggttttgccacaaaatgccaacctttaaaataatgctttgataggggagaaagggagatgcgaatctgctgcttaatgaagagattttaggcattgattaatcaagctttatggcctgttgggtggggaaaattcaatggtccttgcaggtaaattgtcagacttcaaaaattacttcaaagattcttgctcttcctaagagtgtttgtcttgggaaatgataaatttggtcactggtagagaacaattaaaaatacgttgttatttcttttagtctataggtaatcttgacttattttacagtaagattagcacaggttgtttacccagaacactgccaagataaacttacagcctgcttctcaaagtttgtgaaggtctttttcgtaacttcaaatttgtacatttttgttaccacaacatctgtatcctaacttcacctttgctggaaaaattataattgaaaggtcataattctggtgctttcttctggcttgcattggggttaactagcacactgaaacataatgttcattcaccctagccagtgagtccaaaccatgtgaggtgtatgagagcaaccctgtttccatccaaactgcacatatggtgtgggtaagccagtaatgtgagttttatgcaatgtttctgctcatgtacacagtctgttgctcagcaccaattattccctgccagaaacccgctaacctgctgcttttgtacctctgctggatgaagttaggtagcttaaaatgaccacaatgatatttatttaactttagcaatctttgtttgttaaagttatgtaactttaagtgcccaacacatctgttgattgatcacaattgattgcaattagaatctaagaactggaacattgttactgcagtttgtggagatacacatgtgttaattatatatatttagaaggaggaatcaaaatgtggaaatactagctttttgtttatcaaatctagttttatgtcttcaattgagatattattatttaaaaaacgatatataatattctgtttatactttggtagtcaccttgttgtcattgtttccagtttctacttttatagctttaaaaaccacaaaatcagcagggtgagaggtccatgttgggagaacaactgttccctatttcacacagccatcttttttttttttttcaaattctgttttttaattagtggcaaatggtccttattttgtcctcctttggtttatattaccattacaacttcttgagactatatagagagcttaagtgcagccatttttatgatgtcttccgaccactagagattccttcttgaaggataaatttcatctgaatcttcaggcagtggaaaagtaacatgtaggtatgcacctggtctaactgacattatctgaatattccactttgtacctactgaggagtcttcttatgaacatgcctacatgagtgcaccagcatgaatacatagaaaaaaaattatactttagcttagtacaatttacgtagattttccatttttctccaggcgtagccagccccattccttactatgtgccaggtttctttgttgttgttgttgttgtttttagatggagtctcgctctgtcgcccaggctggacaaccttggctcactgcaacctccacctcctgagttcaggcgattctcctgcctcaacctcccaagtagctgggactacaggcatgcgacaccacgcctggctaatttttgtattttttagtagagacagggtttcaccgtatcggccaggctggtctcgaactcctgacctcatgatccgcctgccttggcctcccaaagtgctgggattacaggcatgagtgactgcgcccagcccctttttctgcctttttatgccacttgcagagggagaaaagattggtgtatgctacacgtaagagcacagtgatagtgtactgaagtaccatttacattaaaaaaaagcatatgaaaactttctcacaactttttagctgagaagttggtaaatggttgtataaccctactttttaagatggtttctcttggaaaatagtttgaagaacatgctgtttatttgttcatcgagatattctggcatttatgactagctcaaaccaacccatcggagagctgtatatttctacctcattgccttagtcctgcacagattgccttccttgtactgttgttcagtttgattgaataacttggtgagaaactgctgtgtggaatttactgatatttattatggaggtgttactaaggcattgtcaactacattagatagtttcccatgtgaagtcctacttaggtattctaatttcatattgctttttatttattttttttttttgagacggagtctcgctctgttgccaggctggagcacagtggcgtgatctcggctcactgcaacttccgcctcccaggttcaagcgattctcctgcttcagcctcccaagtagctgggactacaggcacccaacaccacgcccagctaatttttttgtatttttagtagagatgtattttcaccatgttggccaggatggtcttgatctcttgactttgtgatccgcctgcctcagcctcctgaagtgctgggattacaggcgtgagccactgtcatattgcttttatactaacaaaatattttgtttttcttgaggtggtaatagtctctttttctcatggccattgtaaattttgtgcctaactttgttttttcccattttccattggctagggggaagctcagacctaaatttacagttcagttttagtaactatttaagaccttatgagatatgcatctgcttgctttattttcctctcacctgatgctcctgttctatatttttcctggacgtaatttttaaatttattgtgagtctttttagttgcctcattcattttgtagaggaaagggttaaaatatattcctatatgtaagtatatttatgtaatacttctacaaaatatatttatatttagagtgtactttttattttaataggttgtaagtggtatacataacctctaattttaatcatcttttgctcctctttcaaatctctgataaaatcatacataggggtttgactgcgagaacgtgtgtgacattgagtaccttccttaacctgtctctcccatgcctcaggtggagtatggcagtcagctacacacttacctccagtgcgatgtgatttcttcagggtccttattgatttgaagatgcaggtgaaaggagcctcctttccaggtcatcaaccttgccaagctgctttcgggcagggtgtaccgcaggcatcttgcaagtctcactacttgtcacatcagccacttcatggtctcccttctgtatacactttcaatcctagatatgctttttagatggcttaccagttggatttttgatatcagtatagaggatgtaggacaagtgcctttctaacttagagagaaagattgtctcgggagtgatggttcctcacagtggcagattttcataacccttgctgtagtatggatagctgtaagaatgtgaactgtatcagacagacttgtagctcagatcttggctttaccacttattgtacagggttactataagaatttggtgagtcaatatgtaatatttatttgtatgtctatatacacagtatctgatgtatactagatactcagtaagtattagtttctttttagattggaaggaaattatggttaatgccttaaaaatcatgccagagtagagtagaattgattaaatcatttaggaattatgctcaattgagagttacagtaaaaggcaggggtttaatttggggcttaatttttctcatgtgacaagaagtctcatagaaggtagttaaagtattgattcaggagctcaggaatgttaagaccaaagtcctatagttcctcatagttgcaagttagctattgcagctccagccatcatatctattttccaggaagcaggaaggaggaagacagcaaagggagaataaaactgtgtccagaaacttttcaaaaaatctctaacagttttactggccatattataacatatggccacccctagtggcacgggagcctggtaaggagcctactttagcttggtactttgctactacccccagaaaaatcaggattctattaaagatgaaaggaaggatgaatattgggtaggctacaagaggtctctgacatagatatcaacctattttgcttttagaaggttcatttgtccaacaatagatatcagtggaggtgggggaggacaaatagagagaagcattcattagtgatgcctggattctatttagggccacgaagtctttgagtagtcatagtgggacaagaaataaagaaggacattaatttaaaaaaaaatcttggataagctaagcacaatgctggtaggacctttacatgtattaactcattaatttttacagacgaggtaggcaatattatctatatatcttatagaggaggaaaccaaggctcaacaatacccatttcccaaggtcacaaaaaaaacagtaacattaatggaaccggaattgagacttgcgcctgactaaccacaaaacctatgctttgcatcgtgttgttttcctgtctccactatataaataacgctgcagaaacctgctgtttcactttgcttctcttttccgtagtgccttctcctgtgaggtccacaataactatatattgacttcaatgatttgtgtgcagaactaaactgagtgttctataaaagattgctgctgttagttgctgaaggctgtagagatgaggccgggagaggaagaagtggtgcttctctcttatcaccgccactcagaggtgggaatgactgccttgggatatatgccaccagtgtcggtagcattcaaggacattctttgggacaaagagaatgtggcaaagcagcagtgaccaatctgagtgagccaaagtccaaaaggaaagctgatagaatgagttggcatggaggtgtatcttctcaagtcagaagcctgggaattatctttgacttcttcctctttcattctcaacccaattgatcaccaatcactttatttctacctcctctggctaccttgcttatctgtcctttcctctacctccccactgcaactacagtggttctggccttatctttcacatggattattacaaagagtttttgtaatagcccttaatgcccagtcctactttcattcaatccattcacccacaaatctgaccatgtagttgccttacttgatggcatcagaggctcttcagctgcctgtaggataaaatccagtaatttgtgtctactgtgcatatatggtccttcgtggtctggtcctgctcctctgtgtaaacgttcaggtctgttctgtgtcaccatacagagtttcttaccatttcttgagtatattcctttctcttgaagtttgtgcaatttctgtcacttctctgaagaactttatcccatacgtcttgtgttcactgagcaaattcctgttcatccttcaaacccctgctcaaatatctttcatcttcaatgccatttagtctcccctctggtcccttaacaccttgtacatctgaccaggagtgccatgaagtggggattcgggttgactcatcattgttccctgtgcgtggcatgcatcagccactcaataaatatttaatgtttgatgtgtgcaggaacagtcagactagacaaaagacagaagaacttgttatctaagtattactcttaaccatgaaaagctctaactttggataacctccttacctttcggtgctagagtaatgggaatatatttgaaacattacttcatctctccgaagtgaattattctcaccaggttcttaacagtttctgttagtttttcaggttatgtttaataattcccatgataccagctgaatgatgattctaattctcaaatcctaaagtgactcttgcctctcttgtccaatttaacctgccacattgattttttatttgttatgtattatgactttcctcaaaacttggttgtattttggattttcttttctgtatctcatccgtttttgcatccgttcctgactaaagacacattttcaatggtactttttaccttttagatgtttcagtatgttccccccacccccttttctttgagacaaggtctcactctgtcacctgggctggagtgcagtggcatgatgtcagcttactgcaacctgcaccttctgggctcatgtgatcttctcacctcagcctctcgagtcactgggactataggcatgtgacaccaggctcagctaattttctttttaaactttcaggttcagaggtacatgcacaggatgtgcaggtttgttacataggtaaacatgtgtcatgggggtttgccatacagattatttcacccatgtattaagcctagtagtacttagttattttttctgcttctctccctcctcccaccttccaccctctgataagacccagttgttcccctctatgtgtctgtgttctcatcattttaacaccctcttataagtgagtacatgctgtacttggttttctgttcctgcattagtttgctaaggataaaggcctccagctccatccatgtccctgcaaaggatatggtcttgttcttttttatggctacatagtattccatggtttatgtgtaccacgtgaacagacactttgcaaaagacatacacctgtccaacaatcatatgaaaaaaagctcaacatcactgatcatcagtgaaatgcaaatcaaaaccacaatgagataccgtctcacatcagtcagaatggctattaataaaaagtcaaaaaataacagatgctggcaaggttaaggagaaaagagaatgcttatatactgttggtgggagtgtaaattagttcaaccattgtgaaagacagtggtgattcctcaaagacctaaagacagaaataccatttgacccagcaatacctttactgtatatacccaaaggaatataaatcattctattataaagacacgtgcacacttatgttcattgtagcactattcacaatagcaaagacatggaatcaacctccatgcccatcagtgaaaggctggataaagaaaacatgctaatttttgtattttttgtagagacagggttttgctatgttgcccatagtttttcctctgtttttttgagacggagtcttgctctgttgcccaggctagaatgccatagcacagtctctgctcactgcagtctccacctcccaggtccaagcgattctcctgcctcagcctcccaagtagctgggattgcagatgcatgccacaacacccagctaatttttgtatttttagtagagacgggttttcaccatgttggctaggctggtctcgaactcctgaccccaggtgatccacccacctcagcctcccaaagtgctgggattacaggcatgaaccaccttgcccggccctctcctcttatttttaagcagtgattcctaagggtaaatttgtgtatgatttttagccccatagtacaggaccttcttgcacaaaaattaggaatttgacaaaataagtaaatgacaagcatctgaagattttcttcaaaccatgaatatattacttctcaaaattttaagcccccatttttgatgtatcaaataacattcagcagttgtttatattacgctgtatctggtaagttgtaggtaattactagaagaatataagattcttgagagctgcataaatgtgatttctgcagggtctctttaggtatgctatgctatacacacgctgggagcctgcagaaatcacacatacacaaaagggccactgaatcagatctgaaagaggagggccattttgagttggataaagctacgtgtatattacttgttttttccacgcctgttgacatggagaaccaaaaccggtgtttcgtgctttcaacaaaaatagttttagttttgctctgaaagaaaaatgggttcacattctgaaaaaggtgattttgtcaccagaatatctgatgagtaaatctgcatttgcatttttatcattgcctaactaaaacctgttcagtttggttaataaattattaatacagttctctaacttctcatccgggtacactgttgaaatagcagaccatcccatttatttcaccaaatatttcttatacacctattttggatgaggctctgttaaactctgttctccatatctgaaaatgtatgggttattactctgccaaagatttgtggttaaaaaaattgtgttaagttctaagactcatcatatcaagatcaagcaaaacaattgaccatgactaactttggggttgaaggctacaactatgtcttttagaggtagttgtcactcaggcaaattttagggcatcacagggctaaacattaattaaccaaatgaatcagttttaaccactgcttttcctcaattcagttaagggttaaggagttactaatacagaaagatggtgatacaggagagtatgagaattattgattaaattatagataaattatagactaaagcatagtaatatgagaatgtttcattttctgacgtatttaacttaattacctaatctcattagaagtgattaagatgaatactcagcttgtatctcaagatctttttaggtattgattatagcatctataagtccactgactttttggtttctacatgcattgcctggcagtatcagtcagttcacaattcaagttgaaattaaaattttctaacaataaatgagaaacaaaaagtaacatttattttaaaatattatgtcttttaaattttgaatattcagatttgaggattgaatactggcacctctctgtcacttatgttttgctaatgatcatctatgcttcagctcctcaaaatggcctgtcaggtgtcagtttagcatgcgagactttaagctgtcttttgtagtttcataagggccaaagagcttgttagcctggaatttagtgtattttggtactcatttgcttttagttattcttttcttgattttttttcaaactcttctcatgaggaaaatgtacaattcctaccaattagtcataagccagtttggatttaggaattgcatagtttattactttgaaatattattttattcaaatatttagcaaatagtaaagatgtgaatatttcactgaatgttgggtgatttggctgataattagatcctcagagaaaaactgaaactcctgaagtttgttgcagaatctgaaaagtaaccaggaaaacagtagtttaatatgttaagtactagttattaatgaaaattaagcgtgacttttttaggattcaattcctgtttttagtggtatagctttctggtattttgtagcttactgtgttcatgaacacaaaagaacaagtaacctcactagtggcttgagatctgactcgcaggaaaacattaggtagtaattaaaacaaagctttccccccacccccaagtttgtgaaattttaagcacactgcctaatgcagtcaccacttgccgcttgtggctattgagcacttgaaatgtgactagtctgtattcagatgtaaaatacatgctgggattcaaagacttagtatgaaaaaaaggattgtaaaatatctgaatattttatattagttacatgttgccatgataatgtttttgatatattggatttaaaaaagaatattaaaattaatttcacctgtttaactttcttaatgtggctatcaaaaaatttaaaattatatgtgtttcacctcactgatttattggacaatgccagtctaatagatttaaaaattcttaatatgtacagtaaatatcagatattaaaagcttatatgatttggtttttaacctctgaacagtcaattctttggaaatctgagaagcccaattattctttggtctcttcaagggctccaggttgaagcagctgttctttgaaattgccagtcctgattcagttgactaatagcaatcgatagatacggaaggctaagtactgctttgcggttgtgcagccaaatgagtgaactgtacctactgtttctctcctttctgcctcttcccctgatggcttttatgtggttgttagtattcagttgatgtttatggtaacataaatctaaattggttttcagagacccaattcatgttttactatatcccataaattatgtcataaattaccatggctgaccatcttatttacaacccttgagtaataatctatcacttattatattattacatattactgtaatattacattaatattacttattagtaaacaaaaatgagttgttgatgtgcttttgtatgatatcagccaaagcaaaacctacatatggtaggaactggaaagcaagcatttattaataatcagcctctcttttccaggggggtttagctatttacctgtgaaaagcttgtgtactttatttaaaatttttgatgtatgtattgtttgacaaaaacttaaagggtttgggcgcactgagaatagtacagtgaagtcacactgtatgaaaaagagagaggcagttgggtaaatgctgataataatgaaatctgtaaggtcagtctgtgaagataaatgtaatatttgaattagtcatctagtttctctgaaaaggtagtaagttaatcttgttccaaaaaaaaacaacccgagcctggtcgttttgtttttcatgcctttcatcttgggcaatcttttgtatatcatgcaaaggaccatacaattagcatgaaatgagagagcgctttttaaatttgatgaataagggctctttttcttcagctgatatgcatgcaaggtggaggtctatatcccaccagcacacagaccacttggtatctgccctgtaagtagctctcagtttatatctgtgccttaatgaggaaagggttctggaagtaataaaagtaagcttaaaatgcatcagaaatagccataacgctttagtgtaaatacagaaaaattcctagatttgaacagttcggcttcctaccttgcttggattccagagatgcccctgtcattctctttttctagcaatcaattgaagacatattagtaagacttctatgaagacgaaaaactttttttttttggttgtcttctctgtcatttataatgaaaatatgctttgttaacaagttttttttaggtgacatgtgtttagaaaaattttcatgcctctatatttttatgggctgtttgcttttcagaatacttgtctgtgaggttatagtgctaatatgtgtcaatgaacattatttattctttctttaaggttttaatattctgttttattgattaggagtgctcctcccttgatgttttatacagagcacagtacttaagagatgagatcccaatgttgttgggaaagtttttataattagtcatttaagctcacacttttatattgttgtgcttcataatcccctaatatgtagttaataacactccttattacataaaggaagccaaaatgtcacccccaaaaagataaataggtcattaattcagccaacttttttcccttaactatgattgccagatttagcaaataaaattactggatgcccagttaaatttgtgtttcagataaacaataaataattttttagtatgtttgtcttgtgcaatatttgggttatacttagaccaaaaaaagttatctatatttgatctggcaacccccgccataactcagccctcttattaactcaaagaattcccaagtctggcaaatgtgatgtttggccctcctgcactccgtttgcccaatttttttgaagcccaaagtgcctcaggtatgctttctcatttgtccacatgtcttttgggagataggaattgggaattgggcaggctctattcacatcttacctacttttcattttttaaaaaagagaaaatgctttcttttttatttttgaaaaacatattagcgtatatatttctggataattttcacaataatatgtttaaagatggtaataaggatgatttaaagacagatttcaatatgagaaatctaatgcatcccctctccattccctttaggtgaaaaatgcttccttgtaaagtgataatattgattcgtaaagctaagaagacacctacagcaaaaagcttcagcttctccttctcacatctctttatttttggttcatttagtattaaatgcctagcagtataatcccagacaaaaacctttgaaagagtgaattcatagagaacgtgcatttcctgggtgccttataaacaatgttgagggcaagtggataaaaagtgactattccaaacaacaaacattaccatcagctgaatgatttttaaccttcctttcctttccctcccgcacctcccaccttgccctccgctccacagaatcagagaggaaccacttgtaacttgcatgtcctcatcctttgtcatctggattattactaaggcttcccaggtgatattccttcctccagcctcactccattccaagtaccccggctcaccttcagtaactacttatcagataaaatccaagttgattagcatggcatccagcaccctccctgatctgtgttctaattaattcccccttcttttacttcttcctcagtgctcaatgctacagcaataacaaatatttgtcatacataaaacattcatatcatcaggttttgttcatttttccctctgactgcaatgcatatcctctttcatctccatagcaaaatcctatcatcctggaaaatcctgtttaggtatcattccctgtgtgaggctttctctgaccactcttcatcatccttagaatgaattctgctatcctacttgagcttttgtatccacttgtggtaccacatgcttcacagtgttttgtcatggtttatttacatgacaatcaccagtagaagtttggaagatttttgaagataggacactatcatcatcattttgaatctctactatctagtactaacccacaaataacaagcacttgagaaatgtttgagtgcctgagtggatcagctttccacttggtaaaactttaggtaaatttcatcctgttaaactggtcctgtgtattagccgctcacttaccaccatttgtctctctttcacatcaattggtgaatagaaaaatggctcttgatttttcaccaggatagctagtccacctatgctgtttattagttaactgggttttgtttttttgtttttgtagaataaataaagtaggcccatatagaggggtggtcatgggtagcattatgtaacagaggtgtaagtttgcctttggcacactttccattcaggtttgtagctctcctttcagtttttatatccttgacctctaaggctgcctgtcaatatcttagagatgggaatagagtggataggaggtgggcgcaggggggagtgtaatcttcctacaggaaaacttttctattaatatcttgtgttccatcccctcagggcctacccatcactgaagttaattaataagtccattcacaacgagatagtcaattatattgatacgttaaagtgtaactcttctcagatagcatttttatttttacagaaactttaaatccatctgtattagtccattttcatgctgctgataaaaacatacctgagactgggcattttacaaaagaaagaggttttaggacttacagttctgcatggttgggaaggcctcacaatcatggtggaaggcaaggaggagcaagtcacatcttacatggatggcagcaggcaaagagaaagagcttgtgcagggaaattcccatttttaaaaccatcagatctcatgagacttattcactatcatgagaacagcatgggaaagacctgcctcttcccacaacatgtgggaattcaagatgagatttgagtgggaacacagccaaaccatatcaccctatttccaaagaatgaataatattggcatgatatattttataacaaatatgcactttacagtaccaaggaaaaaggtgtttgtgaaaaagctgaggaccttttaatcaccactcaaataggattccctagattgtgcctataacgtgtataattgtccctcagtatataggggattggttccatgacctctgcagatactaaaatctgagggtgctcaagtctcaggtataaaatgggcacagtatatgcatataacttacacacatcctttcctatactataagtcatctttagattacttgtaaaagttaatataatgtaaacgctatataaatagttgttatgatgtagtgtttttaaagttatactttattgttgtattggtttttttctaataattttgatcagtagttggttgaatccatggatattgaacctaaggatacagagggctgactgtatgtacatggatgaatcagaaattgcatttggctgaaagtaattgatattcctgaactggtggccttaacaaaacaggggtttgtttttctttatctagaaatgtctcacgttaggcaattgagggctgataatagtggctccatgatactaacagtttcctcaactttttctctttctgcatcaccacctttaatttttgaagataggacacaatcatcattatttcgattctctagtatctagtactaagtctcacaaatgacaagcacttgagaaatgtttgagtgcctgagtggatcaactgtccacttgataaaactttaggtaaattccatcctgttaaactggtcctgtgcgttagccactcacttcccaccatttgttatttctttcgcctcaattggtgaatagaaaaatggttcttgatttttcacctggatagctggtctacccatgctgtttattagatgtgtgatttttatatatcagattgcctctagattacaagatggtcactgcatcttcaaccatagcaggaggggactagggtaaaacccacccccctttaagtaattttctgaaagccccatataacagctttcatttacatctcattgactatatctatcagcaaggaaggctcagaaatgttagctaggcacattgccaccccatcaccatacttacctgtaattaaagaagaagaagaaacgtccaccaatacacaactactaatcttataacaattcaaattttgcctttatggatcattcaattcaaaataattagaactaaaatttagtttattttcattaatatttagagaacattccataagatgcagttactttaatgaattataaggaattataagactattcagaaaatatttatagtatgccccatttgcatagtgctgtgctcagtgccaaagaagatggattaattctttttcccctgaagtgttttatcagtctcacagtccaggatatatatatatatatatatatatatgtgtgtgtgtgtgtgtgtgtgtgtgtgtgtatcacatgaaaatttaaataatggaatattatagcatatgattttgtgttaatcatgtagtaaaaataaaatcacgtagtgtagactaaattctataggaaaaattccagatacaaagagtaattgctgtggctgcagtggccaacgaaggtctgcaaaaggtagattagtagatttggcaggcaaacgagaatagcagagggcagtcctcctgtattcaacttgtgccacctattattttaggatatttatcgtactatatctctgatatattctttaaaatatttttagtattttaaaatattatttatccacagttttaaaattgactcatgttttaatacatatatttgaagaggaaattttatgccaatatcatatacgtaaagctgattttacttaccaactaaagataacttttgagaaaatacagtgatactaaaaattttaaatgcataatgaactagaagtaatagtaagatataacttctagttcattatttaatagtaaacaaattaagttcttcagtgggcaaaatggaacattttgtgatcagtcagtagtaaagggatatatggcttaatggcatgtggtttaagacaaagatgaagttctacctccaataagacaattctgccttttaatgaaaattactaccagcagcaaaaactccaattcacatgtacatgaagttggaaatatataaatatgtttaacccctcttcttataggttgttcatagaatcagtttttaaccaaaatgttatagatgacttttgtttggcaaacaattattcaagaagccactataagaccattttcaaagtctttttcttcttttgaatatgtcaggttattgggtaatgtttaaaaagttgtggaatgaaagagactctttgtcattcaccactaccatcttgtttgtgaaaatacttatgaaaacctttcatcaatttcaaaatatcttcacagaattcatttgaatttacaacctggccagggtttttggatgtttgatagtcgctggttggttaaaatggatgaatgagatccggcattcagtaataataataaaagctattatttgttgttctactgtggttagagactgtgtggagtacagtgcatgcacatatatcatatagctctccctatttgaggagttgagaaaactgatgctcagaaaggtgaaagtttgacatactcaggtcacatacctaatctgtggcacaaactcaaattctgatttgttgggttcagtccaaacacttaagccaagtcactgaatcaaaattggggaatacagctctgactcatgcttcttctcagagcccctggtcccgagcttcttgcggctatatcaacccatagggaccccatccctgctgacttctgtgtgtacacacgcatgctagtttgtgcaggggctaaggggctgcctgtaaaggctttgatccagaaaaagaaaggggatagctcttgacctgtcttgcacacaaccttgcgtttcatttttccttctcctttttgcctttgaagctctcctgaactccagcttcccagtgctcctcctcctcctcctcaatgcttgtacaaccagtggtactctccccactacttaggaattactgaacagatcagagggaattacgacaagaaaatcgactggcccaggtcttctaggtctttgaatgtcaaattcaaaagtttgaactctattttgtatgtggttaggaggtcattgacaataatattatcttaaattaaggtagataaaaatcagtggttttcctcaaaatgcaaacatggaacactattataagggataacatgtctatataatattgatcatatagtcatgtcactgtctaaggaaatgtaagtgtgttgtaatagctcccaaacattttcttgtcaatgttctttttctagcagttcttaccactggcattaataaggacttggccttgtatagggcgtctagcaatttttcataacaacaaatttggtgataaggataaattatttaggaaatagatctttcctgatgaacattttaaattgttactgaatgagcagcagcaatcacttgcatacctgcactgaacagctagtccagtgctaagagcaataactctctacaagtttggggaacaggtgatttctgtttgactttaattcttgaatttattcattcagcatgtaatttttaagcatctactttgatcatagttttgtgttatccctggcaatgtgggaggtagataataagacacttagtgcaaatcatataaatccctggataaaaagttaaagcccattttccttttcgtaaatataaatggacaaaaaaaggaatgtgctgaaacctgagctagaactatagccacagtgctttaggtctcatataatgaatctggctgaaatagcactttatatttttattttaaagaaacatacgtttcatattctgacatgattttaaatgtaatgaacgagcattttacaaaacaattttgtatactttccttgatggaaaatattatgacacaaaggtatatgttaattttgttgtcaccaaacctagtaaaacattagaaaaagcatgtagtatcagcttctggatctccttggtcacataggattaagaggcaaggcaccctcaagtcatgtgtgactgactcatctctttcctcacatttaattatattcactaggagctgtcagagagtctcctacctgtcctctcctttacctttcctgtgccaggaccagagatcaggcccttatcttccctcattggatttactacagagtcttccgacaaaccttcttccttctgacttttgcctttctggtctattctttacacagcactagagttttctactttaaaaaagaaaagttatattattttcccacctctccctcaaaaatctactatgttatttgttccttaagaggcatttgccagtggacctgcaggtctggccaagcccctgctaggactgtgtctaccttgtacgttgtgctggaatcaacttgccatttcctaaacatgcgttgtaatcacacggctctctgtctgcttgctaaagattgagtgtggaataccttttttgtagcagctgctctggaggttagccctgcccttcatttccagcctagaatgtgactgtttgccctggagcctttccaggttctcccatcagaagttcattctctgcttgaagcacgttcatactatattgattttttacctctattaggtaaaaaattatatgttttggtttctctcttttgtatctttctctttcttttccctttttcgtttcttttctttcttttaacatgcgtgtttttcttctttgctctgggtgcccaaaaactgtgagccaacttcaaagtgtggaaaccacagtcatactgattcttaccttcagcatgttttggttcattttccttgtcccagactttctatttcaatggttttctttattctaatgtcagatattgcctcagaacctttgtaagaagagatacagtagggttttgagtcaatataaataaacacatagactaagttctatgaatctttacttgccgatcttgtatctttcagtactggataagtgaagtgaatgtaaattgaagcctgtttatatcttcccatctttttaagtatctgcatagaaaaatttgttattagtttttatgaataagccaatcacccaaacatttcctcatgtggctacaagaatattttttaattataaaaaatataccagtccttaaaatatgtattttattgataaaaatcaatgcttgtatttctctgattcttaaagaagataatattacaacaaatactaatgatatacttatgcatttataaggaaaattatttgtatgaagttagatattcttggctagtattaattggattctcctgactattaatttgatgtaaatcctcaagagttacagttaaggtgacattagttttactctgttttagcctctaacccatatttttgtgttcagcatgtccttatcttaaaagttgctgtcgccaggatattctaagtatctatatcttacagaaatttattcttgttatatatttttggaagtaccattcattggtgatgcatcatatcaattctctgtactcttaaaaaattatctgaaatacttgatcataaaatcaaactaaggaacaaagaagttctatttgttagctccattctggagcctgtctttctgggtacctttcaatgaaagaagtcaatgaaagaagtcaaagtggcctctaaatcacaggccactttttactcttctgaaattggattacttagttttgtgttgtttttaggctcttttttgttgattacgtgaaccaagctccccattgaacctccctggtgacttgagtcagcgttgagagcccggaactgggagccctgattccctttgtggctttttgacaattacctaactttgctgtatttcttcattgacaccgttgggataattgcctttcatacctcgtgggagtattgtgagattaattaatgtttgtaaagtgttttcaggatcacgatgaaaggtattaatttataagcatgtggtattattataattattattagtaatagggatggttgtttaatgcaaattttcttctaaatgtagtgtcatattttcaaaggacaacttctttctttgtggccagatgtggatacaattaaccctttaccctttattttgaagatacaattagccaattgtgtgtgcaattagatgtgtatgcagtttttgcctgaacaactaattacagccctggtaaaacttcttttgaaaaacgctggccctttgaatgttgactctgtctatctgtgtaataagcaatttgtgctaagcatattttggggccatggaggctcctgaatattgaagaattgcttttgcagttacttgagaaagattttatgttcttcataccatagcattgtattttgccattgagcctacaagtcctctcacatggttctagtttcaaaggttttattggtttttcttaatcttgacattcagtggaaatattttccacagactgcattttgtgaaacaggtttttcttttggaatttttttttcccttgaaaattccatttcctttctgtcttcaattcaaacatgtcatcttatatcctccttactcactaaagaggactgatcctctcttcccagatatggcctggtgaaaccatttttacagggtgcttttaatcactacaatgtaacttctacttatacggaaaagtaggaagaaaaatgaggagacccagaagatagtgttatagccatttgtctccactaatctcctaagtgaaaggggaacgtttttggcttttaatggtgagtttagtaacggcctcttttaagacagctactctttaacagtgctcttcagtgatgatcattgaactctgctttgcataatgtaccatgctaccacgaagggggatccagagatggccaaagtacagttgttaacttctaggattttagaacaaactgttgacataagaaaggtgcttctgtctgcaagctgtagtaagtattctacagagtgcaggtgggattcagtggaggtggtgatcacattgattggaaacatcaggagaagcttcttcgtagttgcatttgagataggacctaatgggtcggtcagcttttcatagacaggggggaacgtttgatggaaatgagggaaagtgtttgtctgagcagaggattggatctactagaacataggttcagaaaagagtgatttgtcttgctagagttgtagttatcttgcaaaggaagggataggagatgagactggaaaggcagcttgggaccacagtgtggagggccctgaaagtttggcaggaaactttttacttaattcagctgacactgtggaggcactgcgtggttttgatggagagtgatagactagagctgggctgtgaaatcgggcaggcctcaccatgccagatgaactgcagtggaacagactacaggagaacagatacactcagcaacgttgtggaaattaagaccagagtcatctctggactgttggcattgggagtgaaaaagagagttactacacacatgaggcatactgtggtgttagtatttcttgatatcggcaactatcctgacatgtgaccaccgagggggattcagagatgggcaaagtacagttgttaacttttaggaatttagaacaagctgtagacataagaaaggtgcttctgtctgcagactgtagtaagtactctacagagtgcaggtggtcaacatgactgggaagaaagaggtaagtaccttcaattaaaataggttgtcaggaagcgggcagatttcagagaataactcttggtaattaccatactatggcacatttacacaaataggcaaagatggcaggataggaaatatagttactggagcctattaacctttacactgtgaaaaacgaattagaaaaactacacatatatgctaaatatacaaaaccatagttctatgtatgtctttaatcatggaatagcagccagaacatggtggttactttttcaggttttatttgaaatacttgaaatgaagatgccagagaggaacagtattctcctatctaatcttacaaaagtctgcttcccatcttattctgtcaagcactggtttccaaggagattccgtgggtaacctatcatgtcatcagtctcaagaatgtggagatctacccaagtatccctaacatttctttctttttcttttcttttttttttttttttttttttttgagacggagtcttgctctgtcacccaggctggagtgcaatggcgtgatctcagctcactgcaaactctgcctctggggtcaagtgattctcctgcctcagcttcctgagtagctgggattacaggcacccaccaccacgcctggataaattttgtattttttattagaggcggggtttcaccatgttggccaggctggtctcgaactcctgatctcaggtgatccacccgcctcagcctcccaaagtgctgagattataggcatgagccaccatgcctggcctatccctaacatttctagataacctgatatgatctgtcatccataaatttcctatcctatttcccaggctttttatatttttagactgcactccaccatgtcattggacactgtctcagtctgctcaggctgctgtaacaaaataccatagactgggtgacttaaacaacagacatttatttttctcatggttctggaggctggtaagtctaagatcaagattctggccaattcggttcctgatgaagaaccccttcatggcttgcagatggccaccttcttgctgtgtcttcacaggcagagaaagaactctctccctcttcttcctataaagccacaaatcccatcatgagggccctacccttatgaatttctcttaccctaattatctccctaaacacctgatcttcaaataccatcacatcggcagttagggcttcaacatatgaattgaacgtatgggtgggggtgtgtagggtagaggaagagatacacaattagtccatagcagacagtgagcttgtaattcagggagatactaccaattatttttcaggacacttacaatcagggcagaaggcgaaggggaagtaaggcatgtcttcccactgtgaagcagaagagagagagaaagcaaaggaagccacacattttaaaaaaatcagatctcttgagaactcactatcacaagaacagcatgggggagactgcccccgtgatctaatcacttctctcaatagatggggtttacagttcgaggtgagatttgggtggaaacacagagccaaaccatatcattgatcctattatgttttattcacttaatctgtcaaagactatgagaagtatattagtcactcatcattgtaattctatcattttctgtctgtatttctgcttttttattgttttgtgtgtatcttgatcttgttatttgaagcaagatttgtgacttaaattccattataggttttatcttttatcaacagcaaaaatgtctttatgtattctaaaagcattttgctgtcacttttatatgacattttcattgtaacttctgctttcttttttttttttttgctttaaaaaaaaatcttgctctgtgattttcattcattcattcactcattgaaacagcacttttttttttttttttttttttttttttttttttttttagctcttagcaatatatagaagtgagcaggacagccgtggtcctttcttgggaagtttattttctagtgtgggaaattgtacaataaataaaataattctaatagtagtaagtgctatgaagaaaacacaatagtatgctaacatgataaacatcatgataaaaggcctttaagtagcagtggagattatttgtcagttaataaagggatttaaaacaattacatttactgaaatagctgatatgtgtatgatcttacatcagttatcttattttaggttttctgaggttttgtttccatttagtttgtagtctatttagtttttagttccatttagttatgagtaatatcttgctttatttgcttgttttcttctcaattggtttggaagatgatgttatttttatttacataagtggatatttttacattcactgaaaacattctctaatctaaattttgcctttttatcaaatcaaacaattatatcttttgctttcttcctgtaacatgagaaatttaatcatccacggtcttgctattttatggtctttattaatatagtcttaaagattccatttaattaattgtattaactgtacttaataggttttcttagctacaataattataccgacttccatatttaacagcttttaatgcttactgtcaatttgtgtacaataatttaacctttctgaatttcttaattttagtggtaaacgtgtttacatattactttataaatgtcttcagtatattcttaagctcttggatatttaaaagtggttttctatggtctttacaaaggaacagtaattttactagctataaaagtcttatgttataatctttggtttgctcaaaatgatcactctatggttttctggccaacctgatttttcttcattagtagggaatatgttttatcttttctgtttcatgctataatttattttttatacctttgaagtttagaaatttactatgtatcaagataggtgtgtctcaaggccaagtgagagttagcaaaaacaggttacagagtcagatctgcaaaggtctcagatattggtatatctcatataacacaaactaaatatgtttactatatttaaataaataaaaggcaaacttaaaatattataatgatcatgagaattaaaaattaagtgtatttgggaaaaaatagaacattagaaattaaaaacagttattcaatgcataggttaaagagtatattagacataagcaaagagagattttataggctagaaaacagatctgaaggattactcagaatgtaacacagagagacatagaaatgcataatagtagcatgaaggatataatgaagaggtgtgtctaacatccatcttaatggagagacaaggtcagggaatggggcagggacaatatatgaaaattaggagctaggaattttccaaaactattaaaaaaaaaaaatctgtcttcagatttagaaagccccccaaacacaaagaagaataaatgaaagaaatccacattagacatataatagtgactcagtataacaccaaagacaaacaaaatgaccttaaaagactgccttaaaggaattaacagaactaaagctgatttgtcagtaacagcactggatccaaaggcagtcaaataatatcttcaaagtggtgagaaaatataactcaatctagaagtccatgttcagcaaaaatttgaagattaagggcaaaataatttttttcagatatataaaacctgagtgaatatgcagcaagagactctctctaaaggaaattctaagtgatgtacgtcaggctgaaggaaaatgatcccagatggaagatgtgacctacaagagggaatgacgaactaagaaagtggtttatatgagaataaatctaaactaaaattgattggtgaaacaataatgtaatggcttatagccaacaactccgtagagaagtgattagagtgaaagcattctaaagtccttgctttatgtaggaagttggttaaaacaaaaacaaaagccactgactaagtatgcatgttaacatttctagggtattcactaaagaaaagaaatagtataactctaaactagtggagatttaaaaaggaacaaaaaaagttagtcaacccaaaagcagttaaaaaaagaagagaaaaagaaagggagacgaagcataacaagatgatagaacaaatgtgaatatatcagttactatactatatgtaaattaaattttcctgttaaaaagcacagtttattagattaaattcaaaagatagactagctttaaaaatctaaatacagtactgtggtttacgtgaaaaccctacataagggtacgtaaaggttttgagaaatagggtgacataactacaaatataggtggaatgaactttaaggcaaaaggtgttaccagagatagagggtcacaagataatggtaaaagattcatttcaccaggaaaatatgacacttctaatgttgtatgcccccaataacagactaaaattatataaagtaaaaaatggacagaaacacaaggataaaaagaaaaaatgtcatcagaattggaggttggaatctacttcttttagtaattgatttattgaataaaccagggatcagcaaacattttctgaaagagaggccagataaatattttaggccttgcagggcgcatatagtctgttttgtgtattcctctttgcaccatacttagctcattgggccatacaacaacaggctaaacagattgagtccacagggtatagtttgttgacctctgaaatagagagtaaaaattagtgagggaatacatgatttgagcaacagagttaataaggttgatattgaccatacacgtatggaagagacattcttctcaaggatgcatggaagatttatgaaaataagaagcatacaggaccatagagcaaatatcaataaatggtaaaagattattatcttacaatcaacattatccagtcaactaatacaattagtaaaaccacttttagcaataatctggcatttcttcattaaatacgtgattctttcatgatccagcaagttcattcctggtcatatgctctggatgaactcttgtacactgatagacatacaagaatgatcacagtgctattcatggtagaagaagctagaaacaacacaaatatccatcatccacagaatgaataaataaataatgtttattcacaaatgaaatactcttaaggatatgaaaatagatttaaaactgcttcacatagcagtatggatgaatcttaacatagttttaagagaataaagcaaaccacagaagaataaatacaattatgaaattcaaaacatgcaaagctatccgatatattatttagagagaaatatatagatatattgatctatatatttgtcatgtagctataaagaagagcaaaacaagaataaacgcaaaattcagattagcatttactttctagcaggggaggaaaaggaatagatgggagtgagagcagactccagagttcctggtaatgttctgttccttaaattgggtggtgaaacacagctgattgttgtattttattctttatgccttacacatattatagtatctcgtcattgtttaataaatgaaataaattacacagtggggatggagtaaggaagtatggaaacagcaagggtgggcactttttttgttttttgagactgggtcttgctctgtcatcacccgttctggaaggcaggtgcataatcatggctcactgctgcctcaatctcctgggctctgccagtcctcctgcctcagcctcccccaagctgggaccacagacacatgccatcatgccaggctaatttaaaaaaaaattatttgtacacatagggtccccctatgttgcccagacggatcttgaactccggggctcaagcccttctcttgcctcggccaccaaacccggccagatgaacacttttttttgagcctttttactcttgctgtacacgagagcagagcaatagaacagtaggttggagggagacaggagtaaaagggtttctttgtaaataggacttacaatagcatgttcgaatgctaataggaatgatccgggagagagggggaaaagtcataataaggaagaagagaaggtagtttcaagaacaaagttcttaagaagcaatgcaatctacaaatgagtggtttggccttagggtcaagttgacaagtttaatggggattggggaagaatatatgttacagttgcatgtaggttggtaggtttgtttgtgggaagatgaagatcacatctagagatttatgaccataaatttaaaatgaaactagtcatcatgattctgtgctttcctccaactcatatccagctgctcaagtgcctgcaggtttgcagttggcagaaaattgggcttaactgaggttgaggttttgctagctgaaaacatggtcggaacaaacaggcaatggaattggggtgtatacaatgatgaaacagagaattcaagctggatgaagaaagaatagacatgatggtgacctagacagtgcaaaaatggaccccccattttggggggcagggcaggtcacaaaattggcagagtgtagcttccagagtatgtgaggcagattgttaggtaaatagggttctggggttagtgtagttgttagtgtcagggtctaagatgatcatgggaatacccagctcggttgaaagaaaaggattttggaggacatggaactgagaggatgaagtgttggatgggttgtatatgctcgtggtcttcaaccccgactgcacatcagaataatctgagggactttcatagaatattgatgccccggccccaccccagaccaattaaatcaggatctctgggtgtggtttctcgggaatttatattttaaaagagctccctgagtgattgtagcgtgcatttaggttcacgtagctacgtgaatgttggcattgccaagccaataaaagaagcagtagagagaactgttgtagactgggggactatgggaggaaggaggattgattcagaggatccccgactacttgaacagcacttagcacaatttattgtatatagtgtgcactcaattaatggtagctctttttatttttgttattattgtcatcatcattattattgacagtggcaatagcagcagcattatcctggggaaagtctccagatgttttatcaaaggttcttcacagaaggttaaaaagcactagttttagatgatcatcaaggaaagttcctaataaagtttggcaaaaaagctagaagttagcaatattctgaattgacgttctacagttgttgtgaagcttggaggagttgtactccatcatagcctggcttagcagtctgcacttgtcagaagccagcaggttaggagttgggtaccttcttttcttatgtcaaaaacctaaaggctaagacagctggttgctattttcctgccaataggaaccttagagccttttagttgtgtttcagtgtacctgtgccagggttgggattgggaagaggagacagggattaaacatataacattctaatattttattttacattcccaaattacttcgtgtgcatgtatacactcttactcccttctctgcaaaaggagtattatgagtcgggtaaacagtactatttaaagctaatgtgtacttgtgggtactttagtgactcccgaagatgtggttccactgaagaatgcaaggaattatagctacgaactgtcaatataacaagtgatcttttttttttttttttttgaggccaggtgttgctctgtcgccaaggctggagtgcaatggcacgatcatggctcagatttcaggctcaagcgatcctcccacctcagcctcccaagtacactgggaccacaggcacacacctccacactcggctaatttttgtattttttgtagagttgggttctccttatgttgctcaggcaggtcttcaactcctgggctcaagtgatcctcccaccttggcctcccaaagtgctaggattacaggtgtgaaccaccacacctggctcacaaattatcacatttttgtacaattgcatacgaaaatatattttaatatacattcactggatcactgggaaagctggcatgcaagcagcttagaaaagacaatatcaaagaaagaattcgaaaatatccccatttggaacattccagaatagttccgctctaatttgaagagtaatgagatacatctctctctttatatccaaccagattttagcttgctataaagagacatacctcctatattttgtttccaattgtctttgcactccataataattcatgtcagcttgcattataaatgaataaaagatctaatttaaaaacctatcatctgatatgggatgccatacacttttctccatggccctgtatgaaacaaaaataatgatgacaacattggacaatgacaccaggcagtaaacaatgtaatttctgtacagtgtctctgtcgggtatgttaggtaagcaataacagcaaactaaagtttatgttttataaaccaatcatttttgatactttcagcaacatctttgtcctcatttcaagcttgaaattcccaactgttcatttattattacgtgacactgagtggcttagttctgtgagccccagttctttctctgtaaaatgaggataactctgccttctgcgcagggatgatattattaaaagcaaatgattgtggaaatgctttgcaaattagaaatttctacacataatggtttttatcatcgtttattttttgttgttgtatttctaatccaaaacgtggaccttattttgataagcacaaccgagacctagacagctttaaaacctgatttggcattaccaatatgacacaaggtcttaagatgtcttatttccaacttgtgattgtgatctgtcaaattttagaatgacttattaaggtctaaaagagaaatattactgtattttctgataacctgtgggcagttccctgatggtattgagtaaaatgtggcaaggcaaattaagttacctttttttaaaaaaaaaaaaaactaatatgggtatttcactaagaaagcttattatctgaagaaagctattattaaaataaagagtacatcccttactcaatatgtattcttcagaatattggtcactggtgatccatccttgtttcttttagcctatcctgagaaaattctttttcaccccattcaataaatatttaagcacctgtgatatgccagccatggtactcagggaggaagacagaatacagttattgttaaaaaggtagacagtgtccatgccctcccagacctctcagtctataggggacaaaggtagttacaaaacccagtagggtctgtcctgtgactgtgaagggggacgctgtgggccaagtggatactcttgccatttcttaaataatatggttctttttgagatggttcatccagtactcttagcccttcaaagagagatttttctggacatacaaatttaagaatctagttagtgagtggattttgcagaaaataagtaaagtctctctgccactttaagaaagaaaagcagaagatgccattttaagttcactgctttttaaagttgagcatttgactgcaaagtttgtgaaaggtcaattgctttagcatgtaggtgtccctatcagggcccatgtttgtctattctgagattcactgcgaagttgaacctctttcttggctgaatcagttgctcattgggtggttctagaactaaaatgattgctaaagactggtagattctcctgtgaagaatagtaaacctgttttaaagtgaaagattgttagaacttagagtactgttcttccgattgcttagagagctttgtgtacctccctgtttatttgaactagtctttgagtggattggcaatgaagaataatattcgtattctaacacgcacataatatatgaaaggagatgaagtatactacctatagttgtcttatttattattacctaacattttattgtgctgtttatttggatagagttcaaacttgttcgtgaatatggacctagtaggctggaaataaacttaagacccagtaaaaaagagttgtaacaaaagagttgctatgttttctgcagtgaggattccttatcactttgtgattcttagataaaatcctttccatccaggaaaaattatacttccagaatttaccaaactgacagaacaactaacatgccccaggccaagtaatgtcagttctgtaatcccctaaagccattccttcccataattgcaaaaactaacagggaacccccacaccctggcccctgcacccttgcctgccatgctatatgtttaaaattgacatttgcttgcaagagtaaactgagtgagatactaattcttggtttatgacaaagtgttcctttctggcttgccagtgggaatgaaggaatgcttttgcgtaatgcctgaatacttatcctaaattcatagccgccttctacctgactaaataaaaatgtatgccaaaattattttgaggaccactctggtcgcctcttctttctcttaacaagaggctggcacagcatttcccacataccctgtatgccgtcacttgcagatgtgattattgcagaaccttaatctgaatctcagagtggaaactggttgacatgagggcacaaattctgacacagtccagaattttttttttctttttgctttcaacagcctctttgccgcagacttaccatttctcctttcaaggtggagctaaatgtttaaatactatcacataggtcctggttgttttaaagtgtcctacctagttatgcctctgctattaacttttattttgtattgttagtaggtcctcttaaaggagcccaggtgcattttatagcagtgactggcgttggtagtatcttccccaacatcactgtgttggaattggcattcattgatgttaagatcaaaatgacagctcttcttttgtatgacttcacctaacacatgattatctggattcatttttcttatcttttttccattttagttcaaagttagactgtaagaaataaagttagactctaagaacacaaggctgattcattaagtaagtacattttttcttaggcatctaccatccacaggtttctcatccctaccctccagtgccatgtaagatgctagtgatccatctaatatgttaaacacattcacataaaatattagggaccccttaatttactgtttacagcctttatgcttctaaaaagatttttagtttgcattaagaacttatctttttacaatttatactttaaaacagtagaaaagacatagataatttctgtttagtacaaaagaatccccacccaaggtaaatcttttttacgtaaaaaaatttacataaattattacataatagacttctagggctgcactgtccaatatggtagccacagtcacatgtggctattgaacatttgtaatgtgggtagtctgaattgaaacttgctgtaagtgtaaaatatgaactggatttcaaagtcttagtgtcataaaatgaatttaaaattttcattaataattttttataccaattatgttttggactgacgttttagatatattgggttaaataaaatatattattaaaattaattttagctatttccttttccttttttactgtggctactgggaaattttaaattacatatgtagttcttattaatttctatttaacaagctgctctatagggatcaagatcttctcttctaaccctgtcattttagacttcaggaaacctcatagaatttagagaatttaagtgacttgctttaggtcacatagcattttagtatagtagtaaagcttgagactagaaatttcttttaaatgttaagactagtgcccttctcagtgaaactagctttttgtgactctgacacttttattataagaggaaatgtctattcttcagaatttttcactgaactctttaaagcaaagagtctctctatactgtaggtaaatgttcctttttgtttgtttcataaatttgaaatatcagttattagctattcttaaaatggcgatggttttccctatgaaaaccttacatacagaaccgttatggcagcagaaatattttttaaatagatctagttaataccgtagtagagttttcaaatttccttgcacacttgtaatacaaatatgtcataaattacaaatttttattgggtatcttccaataacagctatcatgttagcatataactgggaaatgatgccagtaagaataaggcctccaggctatgtatttccttggtaaattgttaatactaggcaactatttattttctcttgctaagctttaacactctctttgctagtattgtgagaacagtctatctttgagtgagagatttactcaatcatagtaaagtaatccagaattcagttcttaagaacagtgtcgagtagtgctgcgtgatgtatgaactgtgaccttgggccatttatttaatgtgtctgtgtctcaccttcctatctgtaaattggggttaatactatttatctgtaaggtagttgtgcagatttcaatgacacgtgtaaagaatatatagcatgatattccataatatctcatagtgtccattttatctcaaagaaaaggtaaagatcaagtatttattcttttctttaaaatatctttagtcttctcctgttccctagaaatcctctaccactgaactaacagtttttggtcaaatctggtcatagtgacatcttattttccatagatacgtaaaaatttgtaattattacctgcaagagatattacaattcatacaacactaatagctggagatactttcattacaaatacaatgttcataaaatatcacatgtataaaataaatgtaaacagatgatactatcttaaaaagctcagctgagtagtaatattttttaattggattttcaaaatcatggtaaaattttgatatgttttgatggctattccaaatactgctattataacattgaattggattttaaaacttgatgtgtactgagagttagattgtcgaaaccaatacttttcaataataactcttccagaatttcaaatattttaacatggaagtatggaaattgagtcacataagtttacttaaaagacttttcattctattttaaaaatatatttgatccaccgcatattctcactcataggtgggaattgaacaatgagatcacatggacacaggaaggggaatatcacactctggggactgtggtggggtcgggggagggggtagggatagcattgggagatatacctaatgctagatgacacattagtgggtgcagcgcaccagcatggcacatgtatacatatgtaactaacctgcacaatatgcacatgtaccctaaaacttagagtataataaaaaaaaaaaaaaaaaaaagacagcaatgcaaaaaaaaaaaaaaaaaatatatatatatatatatatatatatatatatatatatatatatatatatttgatcataataattgttttaaagtgatacagcttagggtgaccaatgaacatggtttgcctgggactgtccagttttagcattgaaagttctgcattccaggaagccgtttagttctgagcaaaccaagatggttttcactctagctgatgcttcacagtttacatagctttgtgtatatatatatatattctcactggatctctgtgagataggaatgacagtattgtcatcaccatttcattagagaggccacatgctcagttaccctggctacctgaattagcttcaggtcccattctttatgacattgtctcctttcctccagatttcagttgaaacctcccctccccagtgagcgtttctctgaatgtgcagtcaaaatgagttgtctttttccctcttcatccctactgcccatcccatctcatttcattgcatgttactcccccttataacacttcccacagttggtttcctagtgttttgcccaagttccacactggactgtaattctcaccaaggcagcatcatgactcttcccgactctggtgccgggcacattatagggactcaaatctaaatgaagccttgctatgttgcccaggctggttttgaactcctggctcaaagcaattcttctgcctcagcctgtcaaaatgctgggattacaggcatgaggcacccaggatgcacattttttaactgcaaaaaccgaaaccattatctatacccatttggccaaatttctcaaagccacttggttttttctacatgtagctacaaaattcttaagatatttttagttgacagtcatcttttgatgtatcgaaccaatatgaattaagccaatgaggaatttttaaacttattaaataaagaagtgaattgttgaaagatacctgtagaagctcctttgaactaatgatgtattacctggcatagtattttgaaaaatgataatttttaaccattgttaacattattaatcaactacagtataacctgtttcaatttactagtctctgtttcatttttccctcaaataactgattttaacagactctgttgtactactaaatgtttcaagatatatattatggccaatctgtgttttagtttgccatctcaaaataaaatgacacatgattaatgttttcagaaagaaaacacattttagcaatttttgatacattgctgtgaaattggtaattgggctgaagttacacgagtgttggttggtttcctgcaggaagtcttcactttctatatcaacagttgatctggtgtctaaagtgttcacagtttggttaaaattatactcgataccaaagatagtacttccaccaaggagggtagagtcaaataacacttatggtgttctcaaaaatgacaatagaggatatgccaaatcaagcttactattattgaaatgtttgcttgaaaaagttatttttctgagcattgttaaaggaagggaaagggagagatttatgaaatcttgcctggaaggtgacacaggggtttgaaagccagtaaataattataaaaattataattattattcagtcatcaaacttaaaggaaaagacaaccagaaagtcaagtctgcttttaggattattaggtcaattatcagtatttttgaaggaaagaattttttaagctatccatatgctggcaattttttcatattttactgccaactttatttaaactactttctcaatttgcaaggataacaatacaatttctcttgttctttgaaaaactctatatgccacattcttaaagtattattgttctacctgttatgtaagttatggttcgattttatattacgtgcacttcttggaatgaaatatttcccttatgttgaaatttgggataatgctgagtatgatggacttgatggacatgttcaaatttcattgtagagagtgaggtaatagtgactaacatttattgattacttactgcattctgcattctgtattgaggatctttgccaacattatctcattcaatcctcacatcttacaaatagattcacttattcccattttgactgcccatcccatttcttttcattgcgtgctgctcctccttataacacttcccacagttgcttttcttgtgtttgagaataaaaagtgactgaggtacagaaacataaggtagcttttctaaggtcacacaaatggggagctgttaactactatatttatgttgtgtcctgcagttcaacacagttcactataaaagtagttgtagggttatgcacatagaagtttacccagtgtaaagctaaggagtgtggccaagagcaagacaggtactgtggtctagtgaattctgggaggtcttctgaaggaaggatagaggatgaaaccactctatgacccaaccctgcgatggtcattcaacagtatttattgagtgtctactgtataccaggtattctctcatatactgcacatacaacagagtggacagggaccctgcctcatggagtttaccatttagtaggagattcagaccaaaaactaaactaaaataaaaataggcaaacaaataaaattacatcagaccatggtaagtacagcaaatgaaataatctgtggattgaaacagcagtgtagagaatggggtgaatggggtcacatactttaagatggagtggacagagcaggcctctctgagtggttttaagctgagacttttaagagttaggaggatatgctcagtgggaagcaaggagttttagatagaactgtggagcaaaggcaaattaaaatatgatgccttttcacattcagattggcaaagattaaaaagtctgaaaacacccatttttgatgatgttgtagggaaaaggaaaaccttcatgcccagtataagtctgtacaactactctagagaccaatttggcaatagctagtaattgtgaagatacaattttgtatataaatcctagagcaattattcttaaaagaagttttaaaaactatctatccccatgacatttttaagctatcataaaacttttcctttataactttaatagttacaaagataagaattttttacaaattacaaatattgatatttaaatatgaaactcttacatcattctttcaaacatatttaataatatatccaatggaattgagatcccacagcaatttgatacattacatcatccatttaaaaaatacatgaacaagctaagctctttctcaattcagaaattttgcatcgttcctttttctccttgaactcagatttccatctacttccccccaaagaattgtatcttttatcttgaatgtcttttattgatcacaatatcatatttcttggcaacaaagaaaactgatataagttaatttaaaatatatgtatatttaccatgaccataaggccaagtgttataaaatttcttctgacttattattttaattatttctggtatataatcagtcaaaacaatataagtaattccatgttttgacaattattaaacatgaaggtaattttttaagaaacatatatcttaatgtgatggaagagcttgatatttttcaattaattcatatatctgaggacaattattactagaataatgctaacgataaaatgaagtgaaggatttgggggtcttacaaaggtgtattagtgatttttaagcaccttataagtagaatatacatttcttttaagttcatctaaatattatagatgggttgcaataaattttaaaatgaatgtggatttatgatatccaaaaatatttggggaaaaaatgaaatacttcttttatgagtctaattaagtgttcaaagatatataaaacctaacttatgaccagtatatatatttttacttgaacatgtagctttgatatgttggaagtaaaagtgaaattttcacaactaatctattctgtctcttatagatttacctattctgactggttcatacaaatggaataatataatatgtggtcttttgtgactggcttctttcagttagtgtaacgttttcaagggtcatccttgttgaagcagtactccattccttctcattccttttattgttgtataatattccattgcgtggctataccacattttgtttatctattcatcagtctatgaatatttgagttgttttcaccttttgactattgtaaataatactattctgaacatttatgtacaagtatttgtttgaatgcctgttttcaatttttttgatacatacctaggagtagaattactgggtcttatgtaactctgtttaaccttttgagaagctgccagaacattttctgaagtagctgcaccatttgcactcccaccagaagtgtgggagtgttccagtttctccacatcctgaccagaagttgttattatctgacttcttgattataaccatcctgctgggtgagaactggtatttcattgtggttttgatttgcatttccttggtgactagtaatatgcttattgggcttttgtatatctgctttggagaaatgtctactcatatccttcgcttattctttttaattcattgtcttttgagttgttgaggtttctaaaaaatatattctagatgcaagtcctttatcaaatatatactttttaaatatttcctctcattctgtgggttgccattttactttttgataatgtcctttgaagcatagaagtttatatttttgatgaggtcttatctattttttcttttgttgctcatgcttgtggtgtcatatgtatgaatccatttcaaaatgtgaggccctgaagatttacccttatgttttcttctaagagttttatatgttagcttttataggcttttgatcaactttgagttaatttttgtatatggtttgagataagggtccagtttcattattttgctgtgactatccagttgtcccagcaatatttgttaaaaagactattctttccacattgaatggtcttggcacccttatcaaaaatcagctgaccgcagatacgtggctttatttctggatgtttggaaaaactcaaactgtttttcctctactctcacatcaacataacagcagccaacacagaagatttctgtgacctcaaaatatgtggggatatcactctaccagcaagcaggcaattagttctgtagaagacacctgctgggtgtcctccagttcaattttacttcatctttttcgagatagtgtcagatcccacagattgtgggctcaatccccaagattgccccacacctcagacaacagtcacaagtccaggcccctggatcttctgacagaccagctttaagttggggttcccacaaccctctctttgggtttgactactttactagagtggctcacagaactcagggaaacatgtttactgattattacaaaggatattttaaaggatacaaataagcagccagatgaagagatacacggggtaaggtctggaagggtcatgagcacaggaactctgttcctgtggagctggcacgtgctaaccttccaacacgtaaatgagttccttcctgtcagcctccacatattcagctctgtagaagccccccgaaccctgtcctcctaggcttttatgcagacatccttggatagacaattgacaactatgtagaaatgtgactggacaaaatggatatgatctaatattaataaactgagtggggaaacccagcaagacctgtttgttcacattcttctcgcctctctgtgcagcatttctttcttcaggatatgaggcaggaccctctctggaatgagggtcgtatagcccaacattcagagtagagtcctgccttgggccatgaaaagagggcaggagaaggtcagaaagagagagtttttttctgaggcctaaagcaccccgacattatataacaaatgctgtgggagttatgagccagaaactgtggacgaaaaccagtatatatgtatatcataatatcacacaggacatttaatcgatttcattgatctatatctctctgcttatgtcaataccacagtctcatgactaatattgcctaaaattttgaaatcagagagtgagtcctccaactttgttcgttttcaagattgttttggcaattctggattcctggcaattccatatggattttaggatccacttttttacaatgaaatcagttgggattctgataaggattgcattgattttgtagcgcaatttgaagagtattgccatcttaacaatactgtcttctgatacatgagcgtgggattttttttttccatttatttaggtcttaatttttttctattatcctttgtagttttcagggtatgagttttgtacttctttcattaaatttattcctaatcatgttattatttttgatagtattgtaaatgaaattatcttaatttcatatttggattgttcattccaagtatatagaaatacaactgatttttgtatattgatcttgtactctgcaacctgctgaacttatttgttccaatagtattttaatgaattccttaggattttctacatagaaaatcatatcatctgtacatagagatagttttccttcttccttcctaatttagataactattattattgtcatcgagatcttgcttaattgccctgactagaacctctggtacaatgttgaatagaagtagcaagaatggataccttgtcttgttcctggtcttaggggaaaagcatctagtctttcaccattaataatgttgtcagctttggttttctatagacacactttatcaggttgctgaagagcccttctattctttctttgttgggtgtattagtccgttctcacgttgccataaggaaatacctgagattggacaatttataaagaaaagaggtttagccaggtgccatggctcacacctgtaatcccagcactttgggaggccaaggcaagcagatcccctgaggctggaagtttgagatcagcctgaccaacatggagaaaccctgtctctactaaaaatacagaattagctgggtgtggtggtgcatgcctgtaatcccagctactcaggaggctgagtcaggagaattgctttaacccgggaggcagaggttgtggtgagccaagatggcaccattgcactccagcctgggcaacaagagcaaagctccatctcaaaaaaaaaaaaaaaaaaaaaaaagataagagatttaattgactcacagttccacgtagctgaggaggcctcagaaaacttacaatcatggcagaagatacctctttatgaggcagcagaagagagaatgagtaccagcaagggaaatgccggacgcatataaaaccatcagatcttgtgagaactcactatcacgttaacaacatgggggaaaccacccccatgattcaattacctcccactgtgtccttcccacaacacttggatgttatgggggttacaattcaagatgagatttgggtggggacacagagccaaaccataccatcccacccctggccgctcccagatctcatgtcctcacatttcaaaacacaatcatatcctcccaacagtccccaaaagtcttaacccagcattattccagcattaacccaaaaatccaagtccaaagtctaatctaaagcaaggcaaatcccttctgcctatgagcctgtaaaatcaaagcaggttagttgcttcctagatacaatgggggtacaggcattgggtagatatacttgtcccacatgggagaaatgggccaaaacaaaggggctacaggccccatgcaagtttgaaatccagtaaggcagtcattaaaccttagagttccaaaatactctgctttgactccatgtctcatatccaggttatgctgatgcaaaaggtgggctcctgaggccttgggcagttctgcctctgtggctttgcagggtacagcccctcccagctgctttcaaggctggcattgagtgtctgcagcttttccaggtgcatggtgcaagctgtcagtgaatctaccattttggggtctggaggatcgtggttctcttctcacaactccactagacagtgccccagtgtggactctgcatgagggctccaaccccacatttcccttctgcactgccctagcagaggttctccatgagggctccacccctgcagcaaacttctgtctggacatccaggagtttccatacatcctttgaaatctaggcaaaggttcccagacattaattcttgtcttctgcatgccccaagaccaacaccacctggaagctgccaaggcttggggcttgcaccctctgaaggaacggcctgagttgtaccttggccccttttagccatagtcggagtggctaggatacagggcaccaaatcccaaggctgcacacagcagggggggccctagacccagcccaggaaaccgtcttttcctcctaggcctccaggcctgtggtgggaggagctggtgcgaagctctctgacatgccctgaagacattttcctcattgttgggtatttgcatttggcttctcattacttatgcaagtttctgcagagggtttgaatttttctccagaaaatgggtttttattttctactgtatcatctggatgcatatttttcaaactttatgctctgccacctcttgaatgctttgctgcttagaaatatcttccgccagataccctacatcgtctctcaagttcgaagttccacagatctctagggcaaggacaaaatgctgccagtctctttgctaaagcatagcaggaatgacctttactccagttcccatcaagtttcttatctccacctgagaccactcaccctggacttcattgtccatatcaccatcagcattttggtcaaagccattcaacaagtctctaggaagttccagactttactacgtcttctagtcttcttctgagtcctccaaactgttccaacctctgcccattacccaattccaaagttgcttccacattatcaggtatcttaagctatgccccactacttcaataccaatttattgtattagtttgttctcacattgttataaggaaatacccgagactgcgtaattaataaagaaaagaggtttaattgactcacagatctgcatggctgggagggcctcaggaaacttacagtcatggtagaaggcacctcctcacaaggcagcaagagagagaatgagtgccagcaggggaaatgccagatgcttataaaaccctcagatcttgtgagaacttactcactatcacaagaacagcatggggaaaaccaccccaatgattcaattacctcccaccaggtccctcccgcaacatatggggattgtggagattacaattcaagatgagattttggatggcgacaccgccaaaccgtatcattgggtgtgttttttttctttttatgaaagggtattggatatttttcatatgtttttttctgagcctattgagttgaccgtatgagatggtcatgtggttttaattttttattctattgatgtgatatattacattaattgagcttccctaaactcaagtaagccatactaggggacaatacaaagctcatgctacagaaaagcatatactttacatatattgaccatacaggtctcttttcaaaaacaaattaacttttgggtataaaaggaaaactgaaggaatagcatcagttgggcacatttttgtgcaagtcagaatagtttttatgtttccttctcactgatcgtctactcagaatttaaaaaatttttcaacttgtgatttgctttactttttatagttgatgatcccaggtattttcaataatttttcaagcaaccaccataaaattgtattttggactatatcacattattcggtttttgtttaggttttagttcaaagcaattaaataaataggaagtaaaatatacacacgggtcttttaaaaaatcaactgtactctttgagcatgaaagcaccactcttttttgcactattttgggcataaatgctgatgatgtacttccccttttcttccacagttaagggtccacccgggagtttacaactatattcagtcccggaaatgttctcattctcttttctagcctctgatataatctcttagcataattggttcaggaatcatgttaagtgggcccagatcatgtgtttcagcctgttaaaggcaaggtatattttcatttcctgagaacagattgcagcctaggtcccaaccatctggcactttcttgccattgcttgccaagtgctatgggctagagaatgtgggcagttgaatgcagtcagtccctgttactggacaactgaccacagaggacttgtctcaggaagagtcgtcctcatgaacacaggacactctgttgtgactttgagttcttaaatttcactggaatacatttaggtaaggtaaacagttatttttaaaatgtattattcagggatcacaacagtgcttttagggattaaaatagtccaaacagcctgtaatttcagggtgtctaagatccacatagaattagcatatcgagctggatataaaaatgacacataatacaacagccaacaatgtttttccccctccaaaaaaatggtgtcctccagattccatctgctttgtttgtttgttttgggagaaaacataagtatgatcattagaaaagaatctataaccctttctgaaagagaagataatctttggtctctagaaacaatagctttgcattttaaaaggcatgaagtgaaatgtccttatactctgttggatttgggaagcagcatgaaatagtggttaagcttatgactccagagttagacggtgtgacttctctgtacttcagtattccccatctgttaagtggagattaaaatagtacctacctcataaaggaaaaattaaattagactcaggtagagagcttaaaacagtgactggcaagtaagtgctcattcagtgtgaactgataacggtggtagtagaaataggcacactatcggaagcttaagaccgatttgatgtaaagttaatgaaacgaaaatcagtaacagctaatataatttatttattagtatgtatcagggctcgtattttaaaccaccttatttttaccctcaggagtgaaccataaattatttagtttcttcagagaattctgattatcaactcacctgcaaagagggcagaggagggaaaaacaaaagctctgttgggctgtaagcatagtttctatacacttaaaaacactttgggaaattatagctgttcacttttaggtcactttggcagttgaaaccatagcaatgatttctagaaggctaaaggaaaatctggtactgggttttaaaagttgactacctagaaactttggtgaaatacgtaatcatctgggtcctagagagctgtgtgatgttgcttcttcctctcagtcattccaggcttttctcttccctagttcggccatcagaaaaaccagcctgacccatggaaaagtcacatggtggccaggaaggaagtgtgtgaggttcttccctataacatccggttttccatttctgacagttagcagacggattatgctcacactttcacttcttgtaaccagtcatttccacctctagctaatggctttctttcatacatgtacatctttcttaatgcccttctctttccagattttgccactaatctcaggaaaattttactttatcaccttgctgtttatgggagtaaaacaaaaaattttaaagaacacaactcatgtatttcctagagatatttctaatgaaaataccccccagcaaactgaggccagcaatcttgaaagtgttcctaagttcctttgccagagttcagctcctccaaactaaattgccttttcaagcactagcattcaggataaattttaatttaatctaatttattgttttcctgatttcaaggcatatattataataatttttctacatctgtgtgttagaagcatataggatttttgtctctattgtgaactcattagcctaagaaaatacattctgacttcttaataattataaagattatttttaggccgtgcttatgagaagattggcacttatctgtatttttcttatttgactcctaagtgtttatgtttcttaccataatcaagaacagtgtgaagttaggtattcttccattatatgagtccttcacataacctttggaatatctttctgaattacgagtatcttttcagtaattactttctttctattgttaccatttatattgatttaagtactatttccttaagaatttttactattgcagatttgtggtctaagtctacttggaagcatggcatttgagagctggatcatctggttcaattatctcatgtttcagaggagtaaattgaaacccagaaaggttaaatgattcgcttaaggtcacacggtttaggtagaggcaggggtcattgagacttgagaccagtgctctttctactaagtcttgcagattaattttcaacttgacgtacaagtaacagaatatattctgataattacctttttcccaaaaatgctaggaatcctggaaaaagatgaccttaagaattgattatccattaatcaacttttctgttgttgatctgaaagcattttttcactagactgtattttcctttaagaaattccaggttgcttatgtaaagtttgttactttgttgaagcattataatttttgaaatttattaagctatgtgaactttaaattttcctcttatgatttttagacaccattgtggcttctcatttttaatcacttcttggtattatttactctattttattgggtagactttctccaagagcgggtaaggacatcttgtacccttataataaccacagaaaagtattgtagtgtagagttccagtgtgtgtgaaaggtcttagggattatggagctgtttcaaacaagattgaaatagtgtcaattatattcagattttaatttataaaatattaaattgaacagatttactttaattatgatttttaaagacaagcaaagagtgtattataaaaatgtacaaatttatcttacccaaataagtttataattcaaaataagcaggaaccatggtttgtgtttctctcacttcgggcccttgctaattgtcttccatctacttaaatattctgtattcctatattcatcaaatcctaatgaatctgttagacttgtttctcaacttttccaccttttacttaaaaatattgtcctggccgagcgtggtggcttatgcttgtaatctcagcactttgggaggccgaggcaggtggatcacggggtcaggagatagagaccatcctggctaacactgtgaaaccctgtgtctactaaaaatacaaaaaaaaaaaaaaaaaaaaaattagcaggcatggtggcgggcacctgtagtcccagttactcgggaggctgaggcaggagaatggcgcgaacccaggaggcggagcttgcagtgagccaagattgcaccactgcactccagcctgggcgacaaagcgagactccatctcaaaaaaaaaaaaaataacaaaaaaaataataataataataattgtcctacattagacaaaagatggaaacaaccaaatgtccattagtagataaatgaataaacaaaatgtggcatatacatacaatgaaatcttattcagccttaaaaaggaatgaaattctgatatatgctacaacatatatggaccttgaaaacattttattaagtaaaatgaccagacacaaaaggatatacattgtatggttccatttatataaggtgcctataataggcaaatatatagagacaaaaagtgtttacaaaaagcttacccagggcttggggagaggagggatggggagttgtttaatgggtatagagtttctgtttaggattctagagatggagagtagtgatggttgcacaacactgtgaatttacttaggccactgaattgtacacttaaaaatggttaagatggtaaattttatttttgtatattttaccacaataacaaactactgtcctgagttagccatgaaatgaaataatagctctgagtgtgcaccaagaagggactcagcctcctgccattctgaatggccacttcatcctcatactggggtggagaaaacacagctgtgtttacttttccaaccccatcttctattttgaaatataaccttttgcaagtgagagccaaggtcaagtgacacagctttctgctcacctcttcagtttgccaaacattgtttttctagtggagttctgggttaggtgcagcaagtgtgagtaacactatcactcatacgcccattggaatttaattagtctaccctcataatttctgtactcagtttggtatgacacatttccttactttcatctgtatatgaaaacacacagttgtgtattcaccaactatagtgtttccaagtatgtggattactctatatatcaaattcaaattacacagaaaataaggcttttcttctccaatattttcccatttcttgaagaattatttactttttgagattagagagatgtttatacatagggtgaacatgagcaattctaagtacatactaagtattagatatttatgtttttgtataataattgtagaaacagtggcaaagcatacattttcagcatatattaagagcagcagaacagattagtttttgtgctcagacaacagccttaacatgaaataactgtattcattgttgtttgtcataacatttaattatttgttcttaaaaatatatatcatacttaggttatgagaatggcaaatgttcattctatcaaagcacacaccaaaaaatccaacatgcagctggtacttaatatttttagatttactttcttcttgtatttttgactgtatcttatgccatttatttgcattcagtcgatatcatataagtgatgtcaatttatttatataaaaacaaattagtataatatatttatattttcttaccaggtttaaaatggaaagtgttccattttctttcttattgtatatgtagatgattgaagtactttatgtttcactgaaatgagtattattcccttcagtgaaattaatgttcagcaatgctgaggagatgggcaagatcatttctcattgttttccttttaaattatctggaaaaaatatgatcttgttgcattacattctgaagaagttgaatagatacttacaataaataaggctatataaatgggaagttaagtattaatagaatccagtgtgactaacaagggatatcaagttcttcagacctgtggtatacataataagcttgaagaattcgtgcacaaaagtcttaactgttttgcagccttggttgtggttagatgctgtagttttctaagctactacatgttgtaaccagcttggtagatttaacctagtaataagatgcttagtttaactgttagtttaaactcagtttctatagcggcacagtctttatttttggaccttcactttccaatccagatgacacttgtccataaagaaattgctaaacttgagacctaaaaacaaaacaaaaaacaaaaaaactacagacaagtaacctttaaaattatttcgcttgatggaaatttaccggaaggctttaaccaattcagtttgcttagactcataaagaaaattatgataatgtctaggtaaacttcagtaaaacatttttttgtgaaattatactatagtacataaaattgaaatattgctgatttaatgtaaaaaaaaagaaatcagcttggccaagttggattaccttgttagagattgcttatgtaggtggcatcgacattgttacgatctggacacaggggatacatacttgttttatagtctatatgtgactgtcattgacttggagtatgggacagggagcattggattttaagtcagaagacccaaagtgtaagtctctgccagttagtggtggtgtgatagtcactaacctctgagcctcagaagattagaatgaaataatagcttccctgtcaaatttagtgagttgtgaggttcaaattaaatacatgtgaaactactttgaaaactgtatagagcaccatacaaatgttatttgttatttttccaaggttctgatgagaacttttctgatctcttagatctaactgagttatcatgaaactttgataaaattgtaccagtatgttgtttcgtatagtactatggggcatgcacatgttttaaacccttagtttgttatattttaaatttccagatcatttaacatttgctttacttcggtttttgttttgtgttttgttttgttttggtgtggttaatgtgccttttttatgtaaatgggcagtagaagttggtgggggtcttaagtactaataaagggcactctttttccttcttgcatcaagagccaatggagaaataagatcaaagagccaccaaacagagaaacaagatacataaagctgtgggtggatagtgtaatagctaagatggacttgtgcactcccactgtcccatgtctacatctgtggggaagtttaaggcaccacaacagactctccctttggccactttttttccccagtccaagtagagagataaggagaaagagactctccctgggccttaggatattagggtttagcttagcccacctagaaatacaggcttacgcctgtcatccactgtgataagaagaaatatatatctggtctttgtctctggttcctgacactgagcttctagaacactttgaatttcctgagtaataggggtgagaggagcatcttttgttatccataacaagttcctttcaaccatgcccgattttatgcagtaaaccctctattgacatcctcgataggttcttggaagctacaactttaagcaaaacaacatataacaaaaccagttttactgtaggttgattgatagaaataagagttaagttgctatggtatatttgtggtcacaaaaaatcaccaaacttctaaataaagatcaaaacacttctaatagtaaacactgaaataaatgtgagctctacatttagaaatattaataaagacaagtaagaacattactcacccagttatttgaatttggacttgccagagcatatcccagcagctcagggtgtgagggggtacccagagctggacagggcaccatcccatcacagggcacactcatacacacccacactcaagcagatggggacaacgcagacacgccagttcttctaacatgcacagcttggggatgtgtgaggaaaccagggtacctgaagaaaacccagctagacatgaggagaacatgaaaactacacacacacacacacacacacacacacacacacacacacacacacacagtggcgtcttgaagaattgagttttttttcttatccatgttgtaacattgaataaaaacaatgttatctgaggacccactgtactaatgagatggctcttggtggtttctagatggcatcagaatgaaggaccatttgccagaggaaccaaccatgtaattagagggttggaaccatcagacccactccttaacctctgggaaggaagaagagctagagattgagttaatcaccagtggccaatgatttttatgcctatgtaataaaacctccataaaaacctctaaatagtgggttccaagagtttctggattggtgaacacattgaggtgctagaagggcgaggtcccggaaggggtgtgggagccccaaactccttcccctgatcttgccctatgcatctcttctgtttgactgttcatgagggtatcctctgtaataagccaatagtgtgaagaaaattgtttttctgggttttgtaagctgctctagcaaattatcaacctggaggagggggttgtgggaatccttgactttatagctcgtcagtcaaaagtacctgtgacctgaatttgtgattggcatctgaaatgggcgcagccttgtgagactgatccctgaacctgtggggtttgggctacctccaggaagttagcgttggaattgaattgaattgtagaacactcggttgttattcggggagttggagaattggttggtatgaggaaaaagcccatgtgtttagtgtcataagtgttgtgactaaaaacaatatagacccaccaactaggtaactcagcctacctccttggggaggaataaggggtggaggagaaggccagagttccttacagaaaaaaatccctgtttatggaaaccagagaagtagatatgaggcttttcctctaacagaggtgaacagcaattaaataaatggaattcacctgcccatccccttgcctaccctcctttgcagctctcatctctgaggctctccttccttttcagtacctacctagtcctgccaccctgttgctgttcatgtccattgtccccaagcataggctacaccacagcccctccagattataccatgtagctggagagaaacactgattcctgggagagaagagttgtgtaaggcaggttggttaaggggactttggagtagatgaggggactttggagtagatgaggctagctcagtgagaagatgggtctgtaggaaaaatctttccccaacaatttcatctacattgtggcaggaccccattaaacttcctttaggagatgtatttgtaaagctgttcatttggcaagtcaaggaataacttatctcatgcttgaggaaatggatgtagctggagtcacaaaccagtttatctctgcatttaataccatccatagtttatcatgttggtgataacgggcaaaatgggtttggtaaaatcttagaaaaacaaagaaacaaatgcaggaattgagggccaacatcctaattcctaacttatttagaagaaatgtgaatataaaatttatgaagagatttagattattcagtcattcagtaaacatgtattgattatctgttatgagccccacattgtgctggctgggaaggaaatgggaatgaaagctgtagtccctggctttgaacagcccgtaggtttgtgggggtgacagggaattctagtcgagtgtgatgtgtgctgtgagggaagtatgcataagctgttaagggaacacagggatggttacttggcccacgtttggggagttagttggggaagtctttctaaaagaggcttgtgtgacctggaagggcaaattgaaataggcaagatgaagggagtagaagagaggatgtcttaacttaggtttaagtaattcaatgagccaaggctcagaactaaagagaaagtgtgtgtacacacacatgcatgaatctacatacatgtctacttttgagggagtggaaagcagtaggcaccatgaaaaggtttggttaacagcggatagcttggtatggatgcagtaaagagtttaggaataagagtacaagaaattggaggggtaagcaaggccaggtcatgcttgtgtgtcgtgataaggagtttggtcttttttcaaaggcattgaggaatgttaagcaaggaagagaatgtgttttatatgctacaagtggtagggagagtgtagtgtagggtagtaaagctgtacatgggaaactcttgcagcattccaggaagaagaccttagtatcctgaatgaagagaatgacatgaacctgaagagaaatggatgaattaggggagatattaaaagcagaaaagtcaataggactcagtgatttattgcatggaggaagtgagagggagggaaacgtcaaagatgatacaggtttctgtgctgggcaactatataggttctcttcactgatagagaaaatattggaagattggaagagcattaagtttgaggtaaggttaaggtaaggaagggactaagctaagagccaggtttaaaacatgttgagtgtaagatgtcctgtggaatatgcaaaaggaaatgtataataggagttgaacatatggatcaggaactctagagagaaatccgagtttgagattggtatatgtgcatgtatctacatacatattacttttgggggagtggaagagtggagcagtaggcatgctccatatcagataagctcatccgaagaagtgtgttgagattaggaagagtaaaggaacagaaatggaaccctaaagaacaccatcacttgagaaatagacaaaaagaataagcagctagacatgtagaaaacaaaactaacaagtgtaccgaagccaagaactaaaaattcagagtcagtagcagtaagtgctacaaagtggtcatttcagattagcacttccaaacattttctgaatttagcaagagagtgattattagtaacctttgtgaaagcagactcagtagaggggtgcaggcaggaggcaggttgcagtgggtgagggaggcatggcagacagtgtgtgccaacaatggtctcagcctcgctgtgaaaaaaacatagaaagatagtatgggagttaggaaggtgatattccaataggcaatatagagttgagtcgaattttaaaaaatggttaattgcttctaggaaagattagcaattaggagactccccctaattgatgaagccatgtccttgaagagtttgcactgggtggatctgcagccctggaagctctggggaaggggttggatacaaatgcagatacatttgttggggggtagagcagatagaggagatcctcactcggtggttgctgttttctctgtgaagtaggaggctggcccacctgccagcagcgaggaggaagctggtgatatagggctagaggagagaagagaaaggggaaatgtgtgctgagaatcatgaggcgggaaggcctactgggaaaatatgagctgcctggacagcttacggttggagtttatgaatttctataaagcaactttaaaacaatttttaaaaaatcactgaaacagccttttgtgttttcaaaaccagtattaaataggatcctgcatttaacgcactatttcttgcctggttcctttcctgaagtgcttctctttcctctttccaccgcgcccccactctagttggctagtagagaagatttttccagcttcagacaaaccacttttccaagaatacatggaacagattacagaagcaagtaacagcctgcttacttccccttctgcacttgtatgtacgttcagctggagttctgaaaagaggaagtcgggagaacatttttttctttttaaaagaaagattggagaaccacggagcacaagcaggtagaaatattgaaggaaagagaaagaagagaaaatggaaaaaatactgaaaaaaaaaaaatcatgagccagaaggtaaaccaaaatgatgtcagagactaggaaaggaacagagaaaataatctgccttctaacctagcctcttagtttgctactgaaatacagcgttcttgaactggagccctcacttctaggcaaaactaacacctaggccacatggagatagaaatcttctgtgaattcagcttctcccccctaatttctgtatcagtgacaacatatcctgggtttttatttctttctttgacctaacctttcaattttaaaatcaagtctgagtgcctagagtatctgaaaaagaaggggaccagatctagtgccattcaaaaacatttaatgagcactttgtatatataggtgctgttctgggtactgggaacttggagaaaaagaggaaacaatctttgccgttgcaatatgatttctcccaagtgaaaggagactattgcttaggaattacataggtgcaggacaccaactctcaggcatttaatagctagacagacatttattagtgaccagcttcttataaaaaataaaaagcttgagtactgccttaactgtgccatagcttatatcaccttctcctaacctctgtcccctgatgcttctaactcagatttgcccctccacctcaccccacagtaatgcaagcagataccagctgaagccagaatagaatggatagttatctagggagataaagtgacagtgttgcttgttcaggctattgttcaaagaagcacgtcttttatttatagacattagaatttaaaggcatagacagccagagcttgatattacctcttctttttgtaacttgttttctagaaatatgcttgatacagctaccttctttgcatgtaaattgaatgtgttggaagagtgttttatacctggtttcatgttcttttaataggttctattgctgttttagttaaggctggtttctaaattttaatgcatcaatattttgcttttatagcatactactttatctctgtctgaggcataggttgcagaaaaaagcaggaggttttaaaagaagccaaatatagatgactttcatattaataaaatattcataatttagttggatatagctaagtagatgaggtctccaattgttagtgcgtctgcaaagttggcgcctcctaatagacttcatggtggttactggaattttgtgccaggaaaaatgtagttgtctgttcttaaacctgaatttccttgctttcaaacacccaagagcgaggttcacaaggatgccactaaccttctgttgctctggggaagtgacttcatttttccaaccctttgctgaaaagtgttatatgccttgtattcttggagtgtgttttttcctaagctctgagaagatttttaagattgaacctcatgaatttttacacccctctgcaagaaagggaggaacagtgcctgtaaacctctttgaattacttgaaataaagataatagaatgtaaggaatgaaaataaatttggccagtcaattttttaacaggttaactgatgaacaagaaatagtttttatacaaacatatgaaaacagcttataacagcaaactttatttgttgtaatgatataaataagaatattaactttctttgtaagattaaaaaaatctgacacggtatgctcatatttaaactaggtaagggcaaccgctaataatttgaaaaagaagtattaaagctaggtttatgaagaaactatactcagaaacattatgatagcatttctgtgaacaggattcatcacaaaaataacaaatacgctttatgaacttagtatttgaattaattttctgaaatttggctattaaccaaaaggttaattgagtcttttcttcttgctctattgtggttaacatactaattcttcccattaaagacccattttattatgcaaatgaaaaaaatcacaagactttgtgtctaagagaaagctgcttttttggaggggaactcatgcacctgtttaaacccccagcccccaccactgcttccattggctgccagacttagtgatcaggtttataggctgtagggtccttgaattttgactcacattttctttgtgacttactcttgttttggcttatatttctccccttccagctctcagcatgccaacagcagctgcatcatggcactcaccctgctgccaagagggcaggcagcctccttggagactgtaatgttgcactatagccaacagttaagagatagatgctggagtaatacttacagcacagctgaaattcacatcatcctaggaggcatttggtggaacactttgcccatcgtattgttaaactaatttttaaaaacttaattatgaaaaattttcaagcttatacaaaggtggaaagaatactatagtgcattcccacttaccttcatgtctgtttcaataattatcaactcacagacaatttttcactgtccacggtgtttttcccatggtcttatccagactgctggtagattcatttccagggataaatatatcttaaactagagttgcttttccatccttcttcagcctgtctgtaagatctgtcaccttaatgattttctcagtcctttcttctttaaggtacaaaatattagcatcttttttcttcctaaattaagccaagatatgctactttaataactgttatattttctaatgctgtaccctaaaattgttgaagcactgttcattcagtcaatcattctatccaaagcatgtctgaaatgtgcaggatcttggaatatagagctttaatggtcattgggtttgattatcagtttcaccactgacaagctgtgtaatctgggacaacttccttaacctctctgtgcctcagtttcctcttgtctttaatacgggactaataggagcacatacccttacaaggctgttgtaagacttaaatgagcaaatacatttaaacagcttagatacagcctgacacagtgttccgtatatgctagttgctgtcttgtcatcattgtcatcctagttgtcttcatcatcttcatcttttgtccctcttcactcattttacataatagtgggttgaggctcaaatgggtaaagcaacccccttcaggtcagatggcagttttatcaggataacttgaatgagaaagcatgtcccaatttttttactgtactagatatagtttgatacattcttgtcctcaaggaattacgttctcacaaataacagagaattgtcaaaaaaaaaaaagaggattaataaaaatatgaggaataaatattgctgctggagagttaagccttaggcactgcgtgtttcaagaggaagagagagaacctcagctgctggggagtccttgccacactcagtctcccaccacatcaagaatctcccctccgcagttccatgcagacctccgaaagaggagggggccttcatgtcccatcagtaaagtctgctctactcagccataaaaaaataaaaaataaaaaataaaaaaaaaaagaagttgtgtgtttagaaagcaaaatgctacaggtaatgtacaggcatacctcgaagatatttcgggttcagttctacatcactgcagtaaagtgaaaattgcattaaagtgagccacataaatttttttgtttcccactacatataaaagttatgcttacactatattgtcatctattaagtgtgcaatagcagtatgtctaaacaaatgtacatgtcttaattaaaagtatactgagctgtctcagggaagtctgaggagaggcagataggggaatggccaactagttggtggaacaatcagaacacacacaacatttatcagttaaatttgtcatcttacatgggcatggttcgtggcactgcaaaacaaatacaataatagcatcaaagatcactgatcatgcctcaccaaagcagatagaataacgaaaaaatttgaaatattgtgggaattataataatgtgacatagacacacaaagtgagcacatgctgctggataaatgactccagtagacttacttgatgcagggttgccacaaaccttcaatttgtaaaaaatggagtatctatgaagtaccgtaaagcaaagtgcaataaaagaatgtatgcctatacctccactttagtgcagaatgtgggatgtcaggaatgcttttgtttaaaaaaggagatgatttcgctaatgaaactctagaacattctatacacaaccaaaaaagaaaagaaagtttgagtgggatgagactaccagatctagggaacatttacacatgagattaagagagaaagcaagaaataaaaggagagggaaaggtattatttgaactaccagtgagtgtcaaaagagatgaatggattctaaacttcatctaaacccaaatgggatctggcatttctaaaatgttatttattcacttactttaacctgtgccgagcactgttctgcttacttataaatataactttatttaatccttgcatttaacaatcctatgaaatagctaactgttatcaatctcataatacagctaaggaaactgaggcacggagaagttaaatattttgcccaaggccatttgcttattaataaacaagagacctgggatttataccaagcagcgtggttctggaatctgtgctcctaaccactttgttctcctgctcacaggtgatcaaagccccggtgcatatggaatcttgaggttttatggtgcacccaaacgttgcttccctttcagtttttctatataaaccagtgtatagagaagccctttaaagagaatagaatggtggtgtcattactcatacctgcactcttggctgacccgaggataattagcatggtgagtcccaattagatttcaggagacaggatctgcccactgcagatgtacatctttataacaagctttatcataatagagtatgattacatttgttagttgcagtcctaaaacagtactctggtgttattttcacatgaaattataagaccactcttataggcatgtgctttttaactttactaattcgaggtcatccactaaaaaatatttcttgatggcctctgttttaggtattggagatgctttgtgacgagttccttctctataaattctctatggattttttcctttcttatgagctgtttcttattagcttataaattgtcattatttctcccaacttgaaaaacaaaaatcaaaagaaacttttcttgactacacatccctttttaactactggcccatatatgtttcttcatttacatcgtaacacctagaaaatactgtctgttctaattttctctccactttctccaccagatctcgtccagctgcagattcaaattatatccccctgcctactaacagctccacctgatgtccgctaggcactgaaacttccaaaacccaactcttgatcttcccacccattcctgctctctggtactctttcccatccctataattggtgattccatgtgtctcatcgctcaggccaagagctttggctttatccttaactgtgctcttgttctcatatccccaccgtccattccatcagcaaattgtgttccttttacccttaaagtctatccaaaatccaaccattttatctcacctttgctatccctgctctaatcgacttcataagtaatctgtcattcccagctatcttcccacttctttccccggccaccccacctctactatctgctgtcaacccagcaaccagggtgattattttaaaacatcagtcagaatatatcacctttccaacaatatgttcttcaagatttttttcatctaacatgcaacaatttagatgaatctcatccacataatgttgagtaaaagaagccagaagcaagagttcatactgtatgattgcattcatttaaaatacaaaatcaggccgggcacagtggctcacgcctgtaatcccagcactttgggaggctgaggagggtggatcacctgagctcaagagttcgagaccagcctagccaacatggtgaaaccctgtttctactaaaaatacaaaaagtagctggacattccagcctgggtgacaagagcaaaactctgtctcaaaataatacataaataaattaattaattaaaaaacaaaaccaggtaaaaccaattctgtgttgttagaaataaggatagtgattgacaggacgggggttgattgtgactgcaagagaacaccaggagggcttctgggggctggtcttttctatttcctgatctgggcgctggttgctcatgtgtattcagtttgtaaaaatttagcaagttacacccttatgaagtattttgtatttttagtacagacggggtttctccatgttggtcaggctggtctcgaactcccgacctcaggtgatctgcccaccttaacctcccaaagtgctgggattacaggcgtgagccaccgtgcccggcccagaaaattattcttctcctttagacttacagtctaagaatttgtcagcatttataaccattagcatttataaccaaagacacaacgtaccagaatctctgggacacagctaaagcagtgtgtagagggaaatttatagcactaaatgcccacgggagaaagcaggaaagatctaaaatcgacatctaacataacaattaaaagaactagagaagcaagagcaaacaaattcataagctagcagaaggcaagaaataactaagatcagagcagaagcgaaggagatagagacatgaaaaacccttcaaaaaaatcaatgaatccaggagctggttttttgaaagattaacaaaatagatggaccattaaccagactagtaaagatgaaaagagagaagaatcaaatagacacaataaaaaatgataaagaggatatcaccactgatcccacagaaatacaaactaccatcagagaatactataaacacctctatgcaaataagctagaaaatctagaagaaatggataaattcctggacacatacacccttccaacactaaagcaggaagaagtcgaatccctgaatagaccaataacaagttgtgaaattgaggcagtaattaatagcctgccaaccacaaaaagcccaataaatctttattgagcagtaggcactgatctaggcatgtggaatacagcagtgaacatgagctacaaaagcttcttggctgggtgcagtggctcatgcctgtaatcccagcattttgggaggcaggcagatcgcttgagtccaggagttcaaaaccagcttgggcaacatagtgaaatcctgtctgtacaaaaaaatacaaaaattagccaagcatggtggcatgctcctatagtcctagctacttgggaggctgagacagggaggatacagtgagccaggatcacgcactgcgccccagcctgggtgacagagcgagactctgtctcaaaaaaataacaaacaaaaaccacgtaaaagtaagttttatataagtgagaaaaggcctcattgagatggcatctgggctagcgcttggaaggagataagggaagtagccctgtgtatgtctgggagaagagcgtcctggtctgagggaatggaaagcaaaggccctgaggcagaagcaggctcggtgtgcacgagcaagcacttgcaaggagcactagcaaggagacagtgggattgaagaggaataggccagggcacacgagctggagatgagggcagaagcacacctggagccagatggcgaaggagctagtaggcctctgtaaagacttgggagtttcattctgcctgagattgagggtcaaggggggagtcatttttttgcccaggctggtttgagttaggttccaggtgcttgtagtggcaggccattcatcttcattgctgtaaataaatttcagtttattatccattcttctattgattgatatttaggtgatttgcaagacatattaattgtaaagaaattgaacaagatatatccttttttaaaaaattgcgtaacttttatgacataacaggttagttccaatgacaatcagacaatcagtactcatggtatacattagagataaattatgagtacatatatattactgtcaaatagtaaagtgtgcaaggttgaaaatacaaagatatgccagatagactgcttgccttcaaggaccctatagtctagttggagataagatatatttgcatatggaacagcaatttgcaaggacacatataggcaacaccaaataacatcttaggcaatttgccccataagcattctgaaataggcaagatcactttgtactccattgatacaagattttatagggcagctgagaatttagcagagcctgaaaacgtacataggatttggaaaagcggagacagaatttgcagacattatctgagcaagggaaataacaagaaggccagtttgtgtttaaggggtctgtgggtggtcagtctgagttaaagtttaggattcattttaaagcctaacagagatttggatgaatgtaattctaaagtaaagtaaagagctgcgttcaaatctgggaatatttatatagcccacattgctcaatcattttgatgtattaatgccacatttaccgttattcaacctcaaagttcacaaggcctaaatgttttaaatgtatgtatttttagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatagagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaa

SEQ ID NO: 1621 - DNA, 8366 bp, Homo sapiens
caagaatttctaaaatagccctttttgaataattacaaagtaaacagttcttcaataccctgctatcaaagtatggactgactaaccaaaggcattgacatcacccaggagcgtgtcagaaatgtagaattttagccctgtcgccactgaatgagatcctgctttttacccaaatccccctaggtgataatgtgcacagatgcttgcaagccattgtctaatagaaaaacaacaccaccaaaatcactccatttccttaatttgggaattgtctatagtattttcagttatgtctgtgaagatatgaaattgtttggaatttgaggattggcttaaattatggttcacagcataactcaatgaaatatttagtgttctttttccacttgcatctagattagtagagatatgatgtttttaatgtttttttcattttaatgaattttggagatgattgaaattagttaatatcatagtgaataatccttgtcttgttaaactactattttaattatgcatgaaatgctgctatcatttatatgcattatgtaatgtattttgataattaggcagctaatatgtagcaaaacacctttatacctatcagtttgtcagttatgatgtcagtaatgatgttctagttgttatcaatggaagtaatccagtgtcaatggattgcttcttaatcgttatagtatttaattctctgtggcatatctcacttatttctccatttggaataactgtttcttcaatttctgttgcatttgtctttcccatatttgtggtttcaatcaagttattcattcctctgagcttcaattacccaatctataaaatgaagattactagtggtacttaattatagggttatcatgatgattatgtgagatagttatgtgaaacaaaaccttacctattgcattgtaataattgttctaaattgtaaatagatgatcatcattttctttttcttcatcatcaccgtcaacgtcattggtatttaagagagctttttaatcttcttatcatttacctcacctttttaaaacctttggtgatttcccataatatttaagataaatttattcctttatcttttacttatctatattaggttgattacttctactacaagtcatacaaaaattataactgctcatcataacaaagacaaaatatttagtttaattcactcttgttttacatctttctatgttgagagtttaaatcgttgattttagaacttttcttttttctgatatatactctacagctataaattaacctgtatgcagtgctttgaccacattttacacattttggtatgttgtattttcatttttatttagtccaaaatatttcctgatttttcctgtgatattttctttgatgcataagttattccaaaatgttatttaattcatttcagggatatttcaggtgtctcctttttattaatttccaatttagttttcgctatggtcagagaaaaactatggttttaatcctttttaactttattaaggcttgtttttggcatattttttattttgcagaaaattcatgtgcttaaaaagcaaagtgccttctgctcttgttattcttttaatgtcagttggatatttatttgattcttattcaatgtctgagattattgctgattttctttctactttttctatcaattactgagaatattttggaaatttccagctatttttggtgttgtgtttctttttttaatattgtcagattttcttcttgttttttgaaattgtagtttttgtacatatacatttacataaaaggtccctttactgacccttttatttttatgaaatgttcttttttgtctttattaaatctgcatgccaaactactttcagctctccaaatatctatcctctgtcatttatttcattttgctgcttatttttacattctgtatttttatcttgcaaatgacctttctggccttaaccttttttttaactcttgcttagcttttgtctaattgtgaatataacctccccttatacctaactactagaaattactcttttcttacaactggcatattctttaacttatcacagtttatttatatttattgcttcacttatttatccattattagccctcaaactcctttacagagaaactacatatttttttgtatttttagtacttagctgaggtagctaaaggaatagtttttaaattgagagatgagtaatatatttctctggagaaaggaatgtacagataaaatatgctttcttatactcttaaaaaagttttaacatgcaatatagatagtttatgagtacaataaaagatttctcccttatatttacaaaaatcacatgggtttcttatttaataataacccaaattctttcttctcccaaaatgaaattttatagtaagttgttttgttaattaagattttgtgtaagaaacagaaatcgtgcatgactaacaaacagaagaaaatgtattgttagcataaggtgttgctaacaatatgaaagggaagaataaatcatcaggttttcaataagcagaaagctttcattccaacagttttcagtcatgtgcattagttgacattcttaactgggcatgcctgctatactgaatgaaatctcatgatttctccaacccatcctataaatattcactcaggatctaaaaatcttaagtgaatgagtccaactggcaaatttaggacacctgtctaacttcctcctgacccataatggtgcaagaaaaaaaattgtcctgggaagtagttttttggcttctctgctcgaagatatgggacttggattcacaaccccaataaggaaaaaaatatctgaagaaataattctttgtttggtcaggagatatttggtgatcaaaagtcaacaaatactcgttatcatggataaccttgatagaagcatattaatatctaataagactatccttctgaaatcagcatttccttattctaggaaaataatatgactataaaataatgtaattgttattaaagaaggcttcagttattgtgattcttaaaaatatttaattaatctgctgcaaagtgaattatatgtaacattttcatcaatgccaattctaatgtagatattcttatcttgcttccaggttacaattgcttgctttctcattgtcagtaagcagtaggtattaagaacacgggttctaagtcaaactactacctcaatttgaaattcttaaattacaagtgataggattgagaggaaggttttttgtttgttttttaagtcacagtctttccatttcttcctctgtcaaatgggagatgataatattgcctacctttattagtttttcttgctgtgtagcaaattatcacaagcttatcaggttaaaacaaggaccgtttattattttatactgtctgttggtcaggaatctgggcatgagttaactgccctttgttaaaccctgtactcagggcttcacaaggctgaagttatggtctgttgagctgccgtctcatctgaggcagaaggacttcttccaaggtcactagttgttggcagagttcagtatattgaagttgtaggtcttaggtttttctagttactgttagccaggggctcttcttagcctctagaagatggccgctgttccctgccacatggccctctctacaacatgacactgtgcttcttttaggccagttatacaatctcttttcctttaaatctctttcttcagtctgttataatggagactgataaaattcaataatcataggagtgactattctaccacctttggcatataatgtaacgtaatcaagggagtgaattttccattgtattcacagattccacctatacttaagggaaaggctttaacatatattgtattaaaatattagaaatgtgtatatgtttatcttttgaattagggtaaaaaaatggaaagttatttaaagtatatgaaaatagagtaaagatattgactgaaataatagtattatagttttgtcaaaatagttctttttatatcaaatatattttattacaatttatgttatcaaatatgttttcactcctactatctcctgtcctttcttctgtaaacccattagattttaattttacttttattaatttattctgtaaaacatttttatgtgaattacatgccaatcaagcaattattatggtataaagacttcatgtgggtaaagacagtgataataactgtttatttaaaaggcaggttttatcttttcagtctactagcatcattgttggcaaaattcactggttctattttcctttataattataaagatgtttgaggaatagatatctttgttaaggatttttggtatttacttgttaatactgtaccaaatttttgataactaattagaagttttttcttttactgttcctaaattatatgtgttgtaaaagtttcttgtagtaccatagtcttatatctatgaatggaattctagaaatcgagaaatgttttaaaatgtcaaatgcacaatatacttactagagtaggaaattttaagttggtggctatttgtacagaattaatcagacattaatttagccattgagatcctctgccatttaaacatattatttgattaatttatgtactttggaaagctgttttaatctaatgtaaatcaaacaaaagttttcttcattgtcttcaaactttaatagggtgttttatgttttaggttgccaatctctttagcatttaaatatccttaagatcctttagaaattctagtgactgtgagacatatagcagtgttatgtgataaatattccaataatatagtaattaaacagggaaaaaatctttttgttttgaaatgctgggaatcatgccattgagttcatttgcatgtttgtaatatgagattttattttggtagcacttgttcttcatgatttataatgtcatgcaattaaatcttgataataaaaaatagaaaaaagtactactgtagcggtagtgctaataacttcaaaaaaagtgtattgaacttaagtactttgtattctacaatagtgctgttcatcaacatttatatatcacagtttaaattaaattagattgactctcaattacctgtttctgagcaaactggctttgacaattcactattatatcaatctgcaaagtgatgtcataatttagattagattttttaatgagaatgatgctaggaattattcttcactttgcaattctaatttccattctatactggttaatttccttactagcattggttaagttatacagaacaaaatagaagaagaagtgaatcctagtgctgatgtctatacaattttatcacaaataaattagcattttcaacatagatgagtcatttgaacacacacacacacacacacacacacacaaaacagaaaactactggttaagtagatattaaagaggatgttttaacttatacatatgatttgaaaagtggctatcataaaaatgtgctgatggagttgcccttgtatatatatattttttaaattgacacagaacacttttcgttatttgtggttcttgtcttttaaattgttatatgcttgaagaagttatcatatatattttcaaatacacttttttcttttttaaaaaagtttcaattctttttgtcatttaaccaaccaaggtaacataaattcaaaaggtagtattagaaattgttaattttatcagttaaagatgtattaactatactaattagaaatataaatgtgaatgatataacaaatatgtaagaaacacatatagaggagaatggaagattttctaatagctataaaataatactggctatgataggtacaaatgttctcaaaattctcacaaggaagatatattacatttacactacattgacagaattgagtagtgaaaccagagaccatattgcccacaaagctgaaaatatttactgtctggttctttacagaaaaagttcgttgactttttatgcaaaatgctcttatctaatcccttatccagagctattctttacaaggaataaaattgtttgaattaggtgagatggtataaatgtaaaatctgcttttctaagaaaatttcttatgacaaacattttcaacttttccagtggtaaaataaatttgagtaaagaagatttttcatttctttatattataaatttttataaagtcattaattatattttgaaatctaatgaaactcttctaaaaattttaatgcggttttgttaaatattcataataatcccatagatatttttagatggttgcccttgtaatatagtattcttttataaactaccctggtttttatataacatattgtaaacaattttagttttaatataatattaattaatgtttttaatactataagaattttttcagatcatatacttccatagtctgttactggaaatttggagttatttttgttttaaaaaagagcaaggtgatgaatatctttgtgtgcattcatcttctattttagaaaattatttcttttgcacatatgtccccaaattaaattattgggttaaagtatataaacaaatttatgattgtatattatgcactaggcattattcaaggtattgtatatgatttagtgctgttattcctaacttataaaatatttttatctaaatttttataaatgaacaaaataacttgttgaatttcatacagtaggcaattgaattgagatatgagactggtcaatttgacaccagatcccattctaccactattaactcacacttctttattttactatcattttattagtattaatattaaggctgaacatttttctatttataaaatatttactgagaagaatttataaacaaacatatttataatcttatatttatatctcaggacagcttcctgaggatattttgttttagctctagacacgcttccattttaaacctaaactggaagtgtgtaaaagttagtcatttgaaaaaaatataactatacttgatttgtttgcaattacaattaagtattacctcttggggtttgttaagaacttctacttcagaaattgtttaaaaaatgacttaatttttggcaaaggtattaaagtatgagtactatattttgggtttgatttgtgagctactgatacctttaagaattcatcaatatccataatctcagaaggcagtatatttacaataatggatcaaatgaaatattaatatataatgacttagcatagcaaatatttcagaatctctcaatagataataaaggtatatgtgacttaagattatacttctacttggactcgtgtttcatattgttatataatgttactagaatcactaaataaatattgaattaatgcagaatagaggattacagcaattctttaaatattgccttacaaatgaatattcagcacgcagtgggttctatgtgtaaatctgtaggttgaaatttagaatttttactaatgtctttatttttgtaattgctctacaagagttgcttattcaaatggcaaagtaaacacttatgtaagataatgtaaattgtggtagtttcaaaatttccatgttcttttaacttttatgtaatttgacgagaataaaaatgcttcttttattaatatatttataatactgaatcatatgtttctccttattttgtactttgatgattggataaacaaatataataatttttaattaattatgtagtaatgaatttcttcattaataagcatttattgagttattcactttgagtagtctaataaattacagtaaaaacacatataaaaatagaattaataaagtttgaatcagtcccaagaattagagctttatttaagaatcattatttgttgcttcatataggaagctcagagaattgtaaagtagaatccaaaatttatacaaaagcggactttattctgtactgaatgttgttagtaactaaaatttaggcataaaagaagttagaggtgaaggtcttaaatattctttgttttagcatatacctagatattgaataattcgtttacatattctttgcttaggttcccagttctgtactaaccgtaaggtaagaaagagtaggggataatctgtttgctaatagaagagtatatattttatttgttaagtaaataaaatggtatgttttaacatttctggacagtttttgcttttcctaaaacattttggtcctatcaaattataaatgaaaattattatttgtaattattaatttaccaacccctgtgctaatggaaaaagaaacttattg

SEQ ID NO: 1622 - DNA, 8285 bp, Homo sapiens
atgcattaaaactcatagaaatgtaaaaattaaatattaaaagtctagtttgatatatgtaaattaaaatatatatgtgcatatgtataataatttcaaactattgtaaaaagatatagctaaagtagtggataataatcagatataagtcaggagagagattgatccaaggtaaacaggtcttccattcttacaaagttcggaagatatgtaaagaaaccatcgacactaaacttttttttttattatactttaagttttagggtacatgtgcacaatgtgcaggttagttacatatgtatacatgtgccatgctggtgcactgcacccactaactcgtcatctagcattaggtatacctcccattgctatccctcccccctccccccaccccacaacaggccccagagtgtgatgttccccttcctgtgtccatgtgatctcattgttcaattcccacctatgagtgagaatatgcggtgtttggttttttgttcttgcgatagtttactgagaatgatgatttccaatttcatccatatccctacaaaggacatgaactcatcattttttatggctgcatagtattccatggtgtatgtgtgccacattttcttaatccagtctatcattgttgggcatttgggttggttccaagtctttgctattgtaaatagtgccgcagtaaacatacgtgtgcacgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctcttcatgtccttcgcccactttttgatgggtttgtttgtttttttcttgtaaatttgtttgagttcattgtagattctggatattagccctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagagtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtacatatgtggcattatttctgagggctctgttctgttccattgatctatatctctgttttggtaccagtaccatgctgttttggttactgtatcctggtagtatagtttgaagtcaggtagtgtgatgcctccagctttgttcttttggcttaggattgacttggcgatgcgggctcttttttggttccatatgaactttaaggtagttttttccaattctgtgaagaaagtcattggtagcttgatggggatggcattgaatctatctgtaaattaccttgggcagtatggccattttcacgatattgattcttcctacccatgagcatggaatgttcttccatttgtttgtatcctcttttatttccttgagcagtggtttgtagttctccttgaagagatccgtcacatcccttgtaagttggattcctgggtattttattctctttgaagcaattgtgaatgggagttcactcatgatttggctttctgtttgtctgttgttgatgtataagaatgcttgtgatttttgtacattgattttgtatcctgaaacttcgctgaagttgcttatcagtttaaggagattttgggctgagacaatggggttttctagatatacaatcatgtcatctgcaaacggggacaatttgacttcctcttttcctaattgaataccctttatttccttctcctgtctaattgccctggccagaacttccaacactatgttgaataggagtggtgagagagggcatccctgtcttgtgccagttttcaaagggaatgcttccagtttttgcccattcagtatgatattggctgtgggtttgtcatagacagctcttattattttgagatacgtcccatcaatacctaatttattgagagtttttagcatgaagcattgttgaattttgtcaaaggcctttgctgcttctattgagatagtcatgtggtttttgtctttggttctgtttatatgctggattacatttattgatttgcgtgtattcaaccagccttgcatcccaggtatgaagcccactcgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataacgagttagggaggattccctctttttctattgattggaatagtttcagaaggaatggtaccagttcctccttgtacctctggtagaattcggctgtgaatccatctggtcctagactctttttggttggtaagctattgattattgccacaatttcagatggtgttattggtctattcagagattcaacttcttcttggtttagtcttgggagagtgtatgtatcgaggaatttatccatttcttctagattttctagtttatttgcatagaggtgtttgtagtattctctgatggtagtttgtatttctctgggatcggtggtgatatctcctttatcattttttattgcgtctatttgattcttctctctttttttctttattagtcttgctagctgtctatgaattttgttgatcctttcaaaaaaccagctcctggattcattaattttttgaaagctttttgtgtctctatttccttcagttttgctctgactttagttatttcttgccttctgctaggttttgaatgtgtttgctcttgcttttctagttcttttaattgtgatgttagggtgtcaattttggatctttcctgcttcctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaacgtatattctgttgatttggggtggagagttctgtagatgtctattaggtctgcttggtgcagagctgagttcaattcctgggtatccttgttgactttctgtctcgttgatctttctaatattgacagtggggtgttaaagtctcccattattaatgtgtgggagtctaagtctctttgtaggtcactcaggacttgctttatgaatctgcgtgctcctgtattgggtgcatatatatttaggatagttagctcttcttgttgaattgatccctttaccattatgtaatggccttctttgtctcttttgatctttgttgatttaaagtctgttttaacagagactaggattgcaacccctgtctttttttgttttccatttgcttggtagatcttccttcctccatccttttattttgagcctatgtgtgtctctgcacgtgagatgggtttcctgaatacagcacactgatgggtcttgactctttatccagtttgccagtctgtgtcttttaattggaggatttagtccatttacgtttaaagttaatattgttaggtgtgaatttgatcctgtcattatgatattagctggttattttgctggttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaacattggcccccactatcttctggcttgtagagtttctgccgagagatccgctgttagtctgatgggcttccctttgagggcaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccaatcagacgtggatttggtcttttcagatagtcccatatttcttggaggctttgttcgtttctttttattcttttttctctaaacttcctttctcacttcatttcattcatttcgtcttccatcactgataccctttcttccagttgttcgcatcggctcctgaggcttctgcattcttcacgtagttctcgagccttggttttcagctccatcagctcctttaagcacttctctgtattggttattctagttatacattcttctaaatttttttcagagttttcaacttctttgcctttggtttgaatgtcctcccatatctcagagtaatttgatcgtctgaagccttcttctctcagctcgtcaaagtcattctccgtccagctttgttccattgctggtgaggaactgcattcctttggaggaggagaggcgctctgctttttagagtttccagtttttctgctctgttttttccgcatctttgtggttttatctacttttggtctatgatgatggtaatgtacagatgggtttttggtgtggatgtcctttctgtttgttagttttccttctaacagacaggaccctcagctgcagctctgttggaatacctggccgtgtgaggtgtcagtctgcccctactggggggtgcctcccagttaggctgctcgggggtcaggggtcagggattcacttgaggaggcagtctgcccgttctcagatctccagctgcgtactgggagaaccactgctctcttcaaagctgtcagacagggacatttaaatctgcagaggttactgctgtctttttgtttgtctgtgccctgcccccagaggtggagcctacagagacaggcagccctccttgagctgtggtgggctccacccagttcagttggagctccctggctgctttgtttacctgaccaagccttggcaatggcgggcgcccctcccccagcctcgctgccgccttgcagtttgatctcagactgctgtgctagcaatcagtgagactccgtgggcataggaccctcccagccaggtgcggaatataatctcgtggtgtgccgttgttttagcccgtcggaaaagcgcagtattcaggtgggagtgacccgattttccaggtgccatctgtcacccctttcttcgactaggaaagggaactccctgaccccttgcgcttcccgagtgaggcaatgcctcgcccgcttcggctcgcgcatggtgcgtgcacccactgacctgcacccactgtctggcactccctagtgagatgaacctggtacctcagatggaaatgcagaaatcacccgtcttctgcctcactctcactgggagctgtagaccagagctgttcctattcggccatcttggcttctcctcccaacaagttcttttgacactaaacttttaaagtagatgtaaaaatatccattttaactattaaaataacaaagtttatcttccaaaccagtagagaaaacaaatagaacagaagtagtaatggagaaaggagaggagaggagtttattaattcaaattaaatgaaaaaaaggagaaagaaataagaaatgaaaatcaaattcaagtataatagtaaacatgataaatgcaaatggttcaaattcactaggttacacagggattatcagactggataataaatggaagttttcctttcttttttactaaaacacccctaaaacatgaagagacagtactgttgaaaatgaaaggatggaaaatgttaaacctgatatgtagcatcagtttggctctccggaatcattctagactgtcctcccttctcatccctctctcacccccaactctcacctcagctctatgccatggatggtgatttatgtatggactacataaatgagcctcttttgctgtgcagcttctgatggtctcaacctgtgggggacacaatctggagcttagagtgttggcagatagagaggtcagagcattgttctcctaagttccttcctgagagaccatagaatggcaatatgtgtgttcctctgtcaaaagccaaaactttagtaagatggccttccacagtattctgtggcctaggaagatttatgaatgcagagttctttctgctttcaaagctaagtgttttaagaaccaaaccctttgggaggaacaacaaaaattggggtgctttatgtgtggtctaagccctttgctactcatggaaaagctgggagtttggggttccttcccagtcattaggtgctgtccccaggtagggtttgtgtgtgagtgtgtcccagattttcctacccgtgttggtgtgggtatattcttattttcccagtgtgtacaagtctctcaactagtttctggttttctccaagagggattgatcaatgtgtagctgtttatttagtgcatctatggaaggagggaaaatcaagagcttcctattcttccatcttgcagatattaccactgcaaatgtccttgggacagaatggtagatataaaacaagtataagtaatttccttgcagtttttgcattttccatgtttagcattcttttcaaaggattagattgtgaattttcagtgctaaataagttatgactaacattccagctggtaatatattgatcagtagtggttgtgagaatggcaaatagataagacatagagatatgataagaaatataataaaaatgcatacctcaatggtttgtgatggtagatactggaaagaagaataatttaagatataattagactttgactataacgtattcagatatttttgaatattattaacaaacttatgatctgtaaaacattaacttctgccagtaattccagagaattatgtgcaatggttattagttgcataaagctggaggaatatttaaatgatctacttaaaattaattactctttgatcaataatcttggtcaaaaagagggcttcctatatcagtatggaaaatattatatttattcacattattttacaattatccttcctttttcattggattctcatttacttaatgaagaaaacacattaaattgttataggaactatatttcagtatctgttcctttgacagtaattgtattagagttccagacctcacacagcttaaattctcattgtacaaagtctactttcaaatgctttcaaaaagacaaaatttccctctcccccttattatttgagtgtaggatgatatattttcttggcctagatcatgatacatacttatgtctgtctttttagcaataatttttaacaaaaatttagcaaatctcattaattttgattgtaactttgaattatattgctttgatctaaaattatttatataacacataatttttcccaaaagtcttttggatcaaaaatgtcaa

SEQ ID NO: 1623 - DNA, 932 bp, Homo sapiens
cactgcaaatgtccttgggacagaatggtagatataaaacaagtataagtaatttccttgcagtttttgcattttccatgtttagcattcttttcaaaggattagattgtgaattttcagtgctaaataagttatgactaacattccagctggtaatatattgatcagtagtggttgtgagaatggcaaatagataagacatagagatatgataagaaatataataaaaatgcatacctcaatggtttgtgatggtagatactggaaagaagaataatttaagatataattagactttgactataacgtattcagatatttttgaatattattaacaaacttatgatctgtaaaacattaacttctgccagtaattccagagaattatgtgcaatggttattagttgcataaagctggaggaatatttaaatgatctacttaaaattaattactctttgatcaataatcttggtcaaaaagagggcttcctatatcagtatggaaaatattatatttattcacattattttacaattatccttcctttttcattggattctcatttacttaatgaagaaaacacattaaattgttataggaactatatttcagtatctgttcctttgacagtaattgtattagagttccagacctcacacagcttaaattctcattgtacaaagtctactttcaaatgctttcaaaaagacaaaatttccctctcccccttattatttgagtgtaggatgatatattttcttggcctagatcatgatacatacttatgtctgtctttttagcaataatttttaacaaaaatttagcaaatctcattaattttgattgtaactttgaattatattgctttgatctaaaattatttatataacacataatttttcccaaaagtcttttggatcaaaaatgtcaa

SEQ ID NO: 1624 - DNA, 1887 bp, Homo sapiens
taagagcctgaaaactattctaatgaggacaaagtaacagaataaacctaggcacatgcccaagggaatgaagtttaatggactgtttagaaaagcatgaggttaattaggttaagattcttagaaagtgagatttgaactaaaaaaaaaaaataataaggtgttttgctgttggaaatgagaagatcataaaattcactaagaacttatccacagtgagtatagagaagagaatgggccatcctacccattgctgaggccaaaacccatcctggctgcctctctacactcacaacccacgtctaccccatcaactagttctgctctcaatgactctatcaccgccattctggttcaaacaccatcgtcctctgtctgtttttgcagtagcttcctgccttagtcgacctactttcacccaggccctattcactctcatcacagcagccagtgtgattctgttaaaatatgcattctggtcatgtccaacctcatgttaaaaacaacagcctccaaggccctgaactatacctcgatgatcttggcttctactgcccttccccttgtttgctcactcagttgctcacacattttaatcatactggatgtgttgctgtcccatgaacacatcgggcaagcattagattctcagggcatggcgtgtgctgttcttccaacttacctactgcatggcaagatccatcaactccatccagtcattgcccagatgtcatcttctcttgaagacccaccttaacaaccatatttaaaatagtaacctcacttctgttttccttatctcccttatctgctttatttttcttcatagttcattatattctttttttgtttgtttgttttgagacaagtctcgctctgtcgcccaggctggagtgcagtggtgtgatctcggctcactgcaacctccacctcctgggttcaagcgatcctcctgcctcagcctcccaagtagctgggactacaggcttgtgataccatgcccagctaatttttgtatttttagtggagatggggttttaccatgttggccaggatggtctcgatctcttgacctcgtgatctgcccacctcggcctcccaaagtgctgggattacaggcgtgaaccactgtatgcagcccattatattctaatatactgcatcttttgcttatttgtgtgctatatcacctgtctcccgcaattagaatgttaattacatgagttcagggacttttacctgtctattatgtttataattgtctccccatctaaaatagtgtccagaacattagtaggtacacaataaatattttttggattaactacattcatttatttgtgctgggaacagcaacaaaactagtctgaagagaaggggctgaaattagacctacaaaagcctgattcagtagatttttcagttggaaaatattgagtgcttacattaagatagttatggtatgatatactgatactgaaatgaaaggtaaaaaccaaagtaaaatttaagtatagatcttaaaatgaatagccccaaaccatttcttactggaaaatttaagtctgactctattgctgctattatagcagagataagagacttacaaaatctagatgaattaacaaaagattaaaatcatttaaaatgttaggagaaaacttaataaaactcttataatgtgattgccaaaaaatgcacaaatatttccaggaagtgttaaaagttgtctattgctaattatatatttgtacttttttttacagctactcatgtgtagaacaaaaaaatagacaaaattactcaggctcaatgattcactatgtacagtttacaaattaattagcttctcttaattttttcaattaaaaaagtgttaaagcatta

SEQ ID NO: 1625 - DNA, 12326 bp, Homo sapiens
ctgctacattcactatgagaaaacattcacgtctcagaaataacagtaataaggggtaagcattgccaggaggaggcagaaggcacatactggccaagtccggctctacgccctgtgtgtacagatatgtcttccaactttcgaaaagtctttgtaaaggttttcgctgatttgagctgttttcagctaagtcaccagaacatccagaatctaattttaaatgaaggttattataatgtccctcagtttcgtagcctcttattcaagagagattagaattctgtgaaggaaaagctttgttttaagttccaagggatgtaaagatttgctaggctgtctttaaatcccatttgggaactcaccatttatataaaaatggatgacatataatgtgtctttgggaacagtgaactctgaagagaaagatatggtcaaatggcccggcctcctcccacctcggaggatacactgcaccctcttcctacccctgatttggccctttcacaaatctcagctctagactgaggcagaaggacataaagatgcccatttccaaagctctccggctccccagtgcctctggttctatccatctttgtgacctgacgtctcagtggctgggtcccagatagggagctctggtctccggttcctggaggctgagcctgaatccctccacgcagaaagagagtcagggacagcaccgggggctgaatccctgccccaccttctagcagagtgacctcagtcaggtgactttactcctcaggctgtttcttttctggataacaaaaggtcattcaaccccatcttgtggattttctgtggagatttagttagataaaggactggcacacagggtgaagtgaggcagccttcccctcttccgcacagtgccacacagaacaggggtctgaggacttgccttctcccctgcatggctggtccccccctacccctgcccttccctggtgtttccaccgcaccccaccagctggaatgacatccaggattgaactcaatagccccttggcttacagggccactttctccacacctaccctggcagacttgatctcatatttgctttcagtataagatccagttgagcatccttccattaatgccccacagaacaagtctcagccttctccctggtgccggcctttccaacacctgaaggcagtgacggtgtgcttctagagtcttctcttccccacattcagcatccacagttccttccagtctgcttcacatgacaccgtctcaagcatggtgccatcctcaaaacacaccccggtttattattgctttcctgctcaagatgctctgtccagaactgatcacctctctggggtatgctgaccaccccaggggatggtctcagaaaccactttctaaattggaatatagactccatccttttcatgactcagtcaggtctcactcttaattcctaaatcccaaataattaacaaaaataccagagtcctgaggggttgctggaaaacaaaactggaaaaaaaaatccagttttcttctatcagccccattgtcccaacaaaggagggggagaggaggctacgtgcagttaccaggtgtgtcctatacaatttggtattgaaggtgattggggtgggggaaggcacgatggcatttccaaatatagaaattggttattcgtttctgctaaactgtatttagttatatctagggaaatcatttcagcctctcggagtccctttggctcacgataatgtcctcttgagtggagccatccctttttactaaatgccatatggcacattcatcaatgtgccattgatgtctttatccaagttaataaaatgattaaatgtaggcttggaatcaccactaaaattctccttgaagccaatttctacctatttatcaaattccaccactgttcatctcatgattaatctacctttaaaatactctcatgcatcactgaacgacagggatacgttctgagaagagtgtcattaagcaatttcatcattatgcgaataccacagagtgcacttacacaaacccagaaggtgcagccttctacacacccaggctctgtgctacagcccattgctcccaggctgcagacatgtgcagcacgccactgcactcaatactgtaggcaacggtaacacaacggtatttgttcactaaacatagacaaagtatggtaaaaatatgatataaaagataaaaattggctgggcgtggtggctcatgcctgtaatcccggcactttgggaggccgaggcaggcggatcacaaggtcaggagatcgagaccagcctggccagcatggtgaaaccccgtctctagtaaaaatacaaaaaaaattagctgggtgtggtggtgtgtgcctgtagtcccagctactcgggaggctgaggcaggagcatcgcgtgaacctgggagttggaggttgcagtgagtcaatatcacaccactgcactccagcctggggacagaacaagactccgtctcaaaaaaaataaataaaaaataaaagtaaaaattggtacccctatataggacacctaacaggaatgaagcttggcaggactggaagttgctctggatgagtgagtgggtggtaagtgaatatgaaggcctaggacattatactactgtagattttataagcactggacactttggccacattaaatttaccttttacaattttctttctttaataataaattaaccagctgggtgcagtggttcatgtctgtaatcccagcactttgggaggcagaggagggtagaccacttgaggtcaggagttaaaaaccagcctgatcaacatggtgaaaccccgtctctactaaaaatacaaaaattagcctggtgtggtggcatatgcctgtaatcccagctactcgggaggctgaggcaggagaattgcttgaacccaggaggcagaggttaccgtgagccgagattgtgccactgcatgcactccatcctggtcagcagaggaagactccatctcaaaataaataaataaataaaataaattaaccttagcatactgtaccttttctaactttatagacttcttaatgttttcaaactttttcactttttcatatttttgtctaacacttagattaaaacacaaacacattatacagctgtaaaaaatatttctttttatatgcgtattctataagattttgctatttaaaaatttgtttttaacttttaagacttttttattgaaaactaggacacaaatgcacacatttgctttggcctccacagggtgaggatcatcaataccactgtcttccacctgcacaccttgtcacactgggaggtcttcaggggcagtgacacacatggagctgtcatctcctgtgataacaatgccttcttctggaatagctcctgaaggacctgcctgaggctgttgtacaattaccctttttaaaaataaaaaataaaaaaaaagtaggccaggtgcagtggctcacacctgtaatcccaggactttgggaggctgaggcaagcagatcatgaggtcaggagttcgagaccagcctggccaacgtggtgaaaccccgtctctactaaaaatacaaaaattagccaggtgtggtggcgggtgcctataatcccagctacttgggaggctgaggcacaagaatcgcttgaacccagtaggtggaagttgtggtagctcagattgtgccactgcactccagcctggacgacagagcgagactcagtctcaaaaaacaacaacaacaaaaaagaagtatactctaaaataatgataaaaagcacattatgataaatgccaggcaatagaaaaatttcagctccattataatctcctgggaccaccctcctacatgtggttcatccttgaccaaagcatcattatgtggtgcctgactgtactactcaaacatattacaatgagaccatatctatttgtcttgaccacaaaaatgtcatgagaaacttactaaaatgctttgctgaaatttagatggcctctctcagtgctctcccacctaggaggctattaccccaatctgaaaataaaggaactggctttaggggttcagcagtgagaataggtgttgacaggaagaagtatccaaaggcctcccagtgggtctccggactgtgtcccttggtggcatccagggtggttgcgatcgtatggtttaaattttgtgatgatccactggagcttcaagttcagcctcaaagcattaggctctgttttctgaacatcattttatatggcaaggtcccgagattctaattttttcttgtgttaattatgtgacatggagcgtcagttaagggaaccatccaatacactttccagaaacagttctccctctcagtttcttcgtgtgcttgactggctcatggccctggggaaaccatcgctttcaatccctacctcaggtccatttcgtgatgtttatgcattcatgcgatcttagtcctcaaaggatttttttttcttctcttgggtaagatagctttagaggccttctgggataggaattataatacaactgagaacaaaggaagaaaaataaaaagtgaactactttctgttttactgaatcattcaacttgacattatctggaaatacaaaaatttgctaacacacttttcctagcctacactttgttatgctgcttgtgaaatgtatgaggtcaacacctttctacccttttttccccattgtcgcaaattctcctgctgtccagagttagtttcaaatgaccctctgctagtcttggccggcatacctaccagtggcttggagaggaattaaggaaaagcttgaaaactgaagctcatttttttgtatggtgttggctagagtttaacgtggttctccaaagccaaaaaaacattttagcagaagcggagcacacacagagataaattatttttctgtactacatttcagttggtaatttcgtacacaggattctatttctgctgctatcaagataaaatgcaaaagtggaaacattccaatgagtaagaagcaggtctgttcattcccagctcatgagaaactcaggacgcacattagtgttctgtttcccagcagcaaatagccaggacatatagcttcaatttactgggattcgaagaagtcaaatcagacctgatttcccatgaagtaaatcatagcacccagctctgtggtttgagtgacaggtacatccattattctgaaaggtcttgttactttcagcagagcttgttattcttagccctaaaaaatcatgccatgtgacagggcacctgaggctgaggaatggggcaccagcaccttccaggctttctatcttacatctgacaacttgaaacatccaggaaagaagtggaaaatccacatatcagatgtgtgctcctacccattccaaatgtctggtgtttgggaaacatttaagggatcataaattctcttttgtgtcaatgtttttggtactgtgtaattacaactatatatgtatagttatgtatatatgtatgttatactatatataaaactatatatagttacatatatgtatatatacaactatataaatatataaactataaatataaaatataaatatatatatttttatatatatatagtatattatatatatacaattttttttgagacagagtcttgccctgtttcccaggcttgagcgcaatgccgtgatctcggctcactgcaacctctgcctcccaggttcaagtgattctcttgcctcagcctcccgagtagctgggattacaggcgtccaccaccacgcccagctaattttttgtatctttagtagagatggggtttcaccatgttggccaggctggtctcaaactcctgacctcgtgatccacctgcctcggcctcccaaagtgctgggattacaggcgtaagccaccatgcccggccattacaactatattctaagattaactagcaatcataagttttttgttttcagtctagattttagaaatgcgaatgacaccaggcccaacactttgggaggccgaggcaggtggatcacgaggtcaggagttcaagaccaacctggccaagatggtgaaaccccctctctactaaaaatacaaaaaaaaaaaaattagccagacatggtggcgggcgcctgtaatctcagctattcgggaggctgatgcagagaattgcttgaacctgggaggtggaggttgcagtgagccgagattgcgccactgcactccagcctgggtaacagagcaagactccatctcaaaaaaaaaaagaaaaaaagaaacgtgagtgacaatttcaacctatttagtatccccaaaagctcaggagctgtgataaattgatacaaataaaaatgtaatacttcatctttttgcaaaatagtgcagtgggctctatgaagacatttctttttattgttgactctggaaagaaaaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 1626 - DNA, 5838 bp, Homo sapiens
aaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 1627 - DNA, 2877 bp, Homo sapiens
acttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 1628 - DNA, 1193 bp, Homo sapiens; identical to SEQ ID NO: 1127

SEQ ID NO: 1629 - DNA, 14244 bp, Homo sapiens
gaaacttagtttagcacagttttaccctaacgtaaaaactccatggattattccggctagcccaattttctagatggtgtgtatcacttgaatattgagattctgattttttattttttgctctgtgccttaagaggcacattcttgtttccattcgagtttggggacatttacaaagtatactgtagcatacttaaattttggttataattcaaattttcattcgtatatatctttaataatgcgaaaggggggctttcattcattaaacttactgaaacaaaatccattgcatctgattcttacttagaatattaatttgaaaatctagaacctcacaattactcctttgtgaatagaagtaagaaaaaatatacgttttactatagactatatacattgctgaagttttatctgtagtaatgtgatcggcttggtaaagcatcctaaacacgttttttaaaacccagaagcaaaaatcacaaacactgctgaaatttgaaatatctaaatacctagcaatcttgagagggataaaaatggtatttcaacaacttcagtattgtaataataaaagtagattcccagagggcacgtcaatcaaagtgtaaaaatttttggaaagtaaaatgcacttttaaaaatgataagcttgcacttggcacatttttaatgatttttttaacgttatcttttgtattaaaaaggaaattcttagaatgggttgactaataccttgctcttgaggtatggacaaaccaatgatggggttttgctaatggagcctaaaatcctttttttttttaatatggaagaatatctgttcccctctcttagtgcacaaagtaacttctatatatggagttatgtattgtacatcatgaaaaaacaatgccatcaaattcaagtatcaaaataattttgctggtaaggaactgtgatgacagaccttttaaagaatttgaaattttaaaatactggtttagaggttagaaaactttaaagaattatttgtaagatatgttaataggttggtagtaggagctaaagattaagattagtctattttatttaaaattcggactaaaagtattttctagtgatttctgaaacaaaaaggttagctccactttaacttagccaattgttaagtggcatcattgtgctgagatgaaggagatggtttttttttttcatgctttttttgtcaacccacatgaaaaacaaaacaactacatcaaaaacaaagtgaactagaagtcaggagaaattctacaagatcagatcaatggttctaaaccttccctggggaactttttttctttaaagtattggcgctatttctgttggtctggacctcagcctgggttttaagagttctaaaagctccccaggaaattctaatatgtgccaaattgagaaccgctatactcgatcagtgtttcccaatgatagttaatcatcagaatcactttggggaataaatttttgttctgcccagagcaactgaatcagaatctctagggtatttttcataggctccctgggaaattcttaagaaatttggggaaaaaatggactaatctgcgggcttccaaaatactgtatctttccatataatagctattttatgctgttataaaagtttctgtgaattaagtggagaaaaatatatgaaacttggtatatggagctaggctttgtctcaaggattttattttatttattttatttttttgagacggagtctcgctctgtcgcccaggctggagtgcagtggcactgtctcagctcactgcaagctccacttcccgccttcacaccattctcctgcctcagcctcctgagtagctgggattacaggcacccgccaccacacctggctaattttttgtatttttagtagagaccacgtttcatcatgttggacaggctggtcttgaactcctgacctcaagtgatccaccagccttggcctcccaaagttttgggattacaggggtgagccactgtgcccagccaaggatattctttttataacattttcaaaaattaaggcatattgtgtatgcaggaaaaaaaatgaagcctatgatttatatttacaattgctttgattttatacaaattaaaatattactgtttatgagaatgagattctaaatgtaaatggaattcacagaatgcataatttttttctcgtttaaagaaatagagtctcgctatatgcctaggctggtcttgaactcctgggctccagccatcctcccatttcagcctcccagagtgttgggattacaggcgtgagccaccacgcctggccttgtacatgttatatagtgaacattttgcacaagattgtttgccaaatgaataatttaaaaaaaatccatttagtgtactttcctttaaatattttcacacctggagttaaaacattgtattttataagatgttattaatataaaaatacttctaattctacttgtggctatgtagaatgtagtagaggacttttgcataagcccagagcctagtttctaaaggtctttagggatttagggaaatcagagggaggtataattctggtctctcgtcgttcagttctttttcattcagttctctcaggcacgactccagccgctcagttttatatttcaactggatgttgacccaattaaaacaattcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaaagataattttttagcatgaaccttttaagagcttgtgagtctcaaagagtctttaactgataggtgatatggataatactcccctttgggaggaggtttataatacataaacaacctccccacccttccctcgcagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagcattacaaggttcagtgaattgtctgagatctcataaatacaacctagataagaacccaggtattattattttcagtcttgcaatattattttcctacttgcaatattatcttcactcttcattaagtttgcacagcaaagtaatggaataagttctgggctttaatccttgagtagtttggaattgtaatgtgctacatttgagagagagcccttcattttgaataaaaccttggtactgatcctgatcttctaacttgggttaatgctcttccccttttcattatttttttcatttgtgaaatgaagtagttgcactagatcattttcaattttccttcccacttaaatcaattttaattaaaaaaattgcagatgccttttctcagattagagtacactttttgctccacacaatatctggtttgtaaattagtatgttccgtggagtaaataactttcctgactagccattaacttacttctgattcctgaatccactaatttaactattgttgaaattactaaaggaaatttttctttagcaaatgtaaaacctcgtatcaggtctcaggtttgatgttgtaaagcactctgactctcaggaagactctttttttcccccaacctctcataaacaaatatttcattcattataaaatttcattcattacattttcattcctcagacttaacagtgtttcgtctctgctaagtatagtgttaagcactgacaaaagaactctggacacaacatcatgaacttgctctctgggatcttataatctagttgcagaaacagattggtaaatacatagtatagcacaagtactataatggaggcctgaactgagtgctgtgggggtacacagatgaaggcttctgggagacatcatggcataactagacctggaggatgaataaaactttggccaagtaaatacagagatacacgaaaagcatggataaatggcacaagtaggttcagggatgataaaagtgttagtatgtggagagtgtacaactattttggggaatggggaaacggattaaatttggggccagaccctgaaggatgtggggatcccatcaaagtcttttaagcaggagaatgatcagatgcattttttggtatactacctgggggataggaggaaatggactacagaaggggagatcagtagaaggaagacaagttaggaagcttttcagtcattttcattaaacatgaagcttaatatgtattgttctaggatcaggaatacagcaataaagaaaaaacttggtgtaatgaaacatattttcttgggagagacagaaaataaacatgaaaaacagatgtgttcaatggtgataaagcagaaagggagatggggagtcaagtggatgtggggagggtgtttagggaagcacttatgaaagagtaacatttgagcaaagagccctgatacaagacaacaattcagacccaagacatttgaggaaagagcatccatataaagggagtgggaggtagagaaagcctggaccaggaatgagcctggtatgattgaggaaaacacaagggatttcactcttgagtgacctgggagctaatgggggattaaacagaggagggacaggatcctctatggtatatggtaagtgagtagtatggtaaatgaggtaaatgaatagtaaaaggaactgctgtggtaatttaggtaacagatgatgatggtttaggtgaaaatggttggattgtggatatggtttgattggttttagaaccaataggatttactggtggctggatgtggacaatgagagaatagaatgaaccaaagctattgtaaacgtctagaaatcagatgaggacttgaccaaaggcattggcaatgagaaagtaggcacaattcatgaggtatttcttagcattgatagagttggatataaatatctggaatttttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacactccacagtcttatcattcatagtttcttggcaaactcaccactcaaggtgtgcctcacttatttaggagatctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcaccctttctacagatgaggaaacagacaacagattggtaagtttcccaagatcacaaagtaagtcagtgggaactcaaagtaacctgactccagagcccactctcttatctaagcatatacattcccatcacaagagaacgccagtttattcaagtaaaataaggactagaaatttacatcaagaaatatattctttcaatgtagaatgctgaatggaaaaccaaatttcaatagttgcctactgaacaagatcatgagataacaacaagggagttgattataaatgactagaagttttaaatggcatcggcgctgataaagtgataatctcagctccatgatatacttgtcaagcagttacttacatcaatctgccttctaggatatcctttctcctggttgatgcttatatgatagtgttttgtacctttcctttttcactgcttccattgctgaccaaactactcacctccatatttctggtagatatattttttctcattgcatgttagtatcttaaatttagtcctatcttttgcttgatcctctgggcttgacttcctaatctatgttctggtttatgttttagtttgacagttgagctttctgaggacattcttattcccagtatctttttttgggtggttgggttctgggaggtggtatttgactgctgctgatgtgtaccaaccaagacagtagtcattaagtgactaacaataatgatttcagcagattattattactcttggcaaaaagcaagctttctctattataaatgattttatatttgttttgtttttctttatttgtaatttgagttctagcttaacattaatacttcagataactgttaatacactttcataaatcatacccacattcttgaatggcaaataaataaataatcaagttccgagtagtttctaaagagagtaaacattaaaagtaaacataaaactacataaaaatcaatcacagtctatttataaagttggtatgaaaacaaagatcctagatttggaacactcatgatactcaatattttacatatatcagagtttgtaatttccataacttcatttggtagttagacatatagacagagaagatattaatatattcattttatagtttaggaaacagacttggaagggcaaataacttgtctaagatgactaagcagctgagtgagaaccacagcctatctgtggcattcagtctcagccatctttcccttgcttcataaggatcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagagactatgaagtcaagtctggctaacttagatctggaagtttttagctgtggaaagcaattctattgtgtacaggtttcagcctgtgaagggaattcattgaaaatgcatagagatcagaagaactaacacctttcttgcatggatttttcttgattattggcagttaacaataaaatgttattagatcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctcaaattggaaaatgaatattcagatactgagtaaatttttttttttttttgagatggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgccc

SEQ ID NO: 1630 - DNA, 12613 bp, Homo sapiens
tgctgttataaaagtttctgtgaattaagtggagaaaaatatatgaaacttggtatatggagctaggctttgtctcaaggattttattttatttattttatttttttgagacggagtctcgctctgtcgcccaggctggagtgcagtggcactgtctcagctcactgcaagctccacttcccgccttcacaccattctcctgcctcagcctcctgagtagctgggattacaggcacccgccaccacacctggctaattttttgtatttttagtagagaccacgtttcatcatgttggacaggctggtcttgaactcctgacctcaagtgatccaccagccttggcctcccaaagttttgggattacaggggtgagccactgtgcccagccaaggatattctttttataacattttcaaaaattaaggcatattgtgtatgcaggaaaaaaaatgaagcctatgatttatatttacaattgctttgattttatacaaattaaaatattactgtttatgagaatgagattctaaatgtaaatggaattcacagaatgcataatttttttctcgtttaaagaaatagagtctcgctatatgcctaggctggtcttgaactcctgggctccagccatcctcccatttcagcctcccagagtgttgggattacaggcgtgagccaccacgcctggccttgtacatgttatatagtgaacattttgcacaagattgtttgccaaatgaataatttaaaaaaaatccatttagtgtactttcctttaaatattttcacacctggagttaaaacattgtattttataagatgttattaatataaaaatacttctaattctacttgtggctatgtagaatgtagtagaggacttttgcataagcccagagcctagtttctaaaggtctttagggatttagggaaatcagagggaggtataattctggtctctcgtcgttcagttctttttcattcagttctctcaggcacgactccagccgctcagttttatatttcaactggatgttgacccaattaaaacaattcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaaagataattttttagcatgaaccttttaagagcttgtgagtctcaaagagtctttaactgataggtgatatggataatactcccctttgggaggaggtttataatacataaacaacctccccacccttccctcgcagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagcattacaaggttcagtgaattgtctgagatctcataaatacaacctagataagaacccaggtattattattttcagtcttgcaatattattttcctacttgcaatattatcttcactcttcattaagtttgcacagcaaagtaatggaataagttctgggctttaatccttgagtagtttggaattgtaatgtgctacatttgagagagagcccttcattttgaataaaaccttggtactgatcctgatcttctaacttgggttaatgctcttccccttttcattatttttttcatttgtgaaatgaagtagttgcactagatcattttcaattttccttcccacttaaatcaattttaattaaaaaaattgcagatgccttttctcagattagagtacactttttgctccacacaatatctggtttgtaaattagtatgttccgtggagtaaataactttcctgactagccattaacttacttctgattcctgaatccactaatttaactattgttgaaattactaaaggaaatttttctttagcaaatgtaaaacctcgtatcaggtctcaggtttgatgttgtaaagcactctgactctcaggaagactctttttttcccccaacctctcataaacaaatatttcattcattataaaatttcattcattacattttcattcctcagacttaacagtgtttcgtctctgctaagtatagtgttaagcactgacaaaagaactctggacacaacatcatgaacttgctctctgggatcttataatctagttgcagaaacagattggtaaatacatagtatagcacaagtactataatggaggcctgaactgagtgctgtgggggtacacagatgaaggcttctgggagacatcatggcataactagacctggaggatgaataaaactttggccaagtaaatacagagatacacgaaaagcatggataaatggcacaagtaggttcagggatgataaaagtgttagtatgtggagagtgtacaactattttggggaatggggaaacggattaaatttggggccagaccctgaaggatgtggggatcccatcaaagtcttttaagcaggagaatgatcagatgcattttttggtatactacctgggggataggaggaaatggactacagaaggggagatcagtagaaggaagacaagttaggaagcttttcagtcattttcattaaacatgaagcttaatatgtattgttctaggatcaggaatacagcaataaagaaaaaacttggtgtaatgaaacatattttcttgggagagacagaaaataaacatgaaaaacagatgtgttcaatggtgataaagcagaaagggagatggggagtcaagtggatgtggggagggtgtttagggaagcacttatgaaagagtaacatttgagcaaagagccctgatacaagacaacaattcagacccaagacatttgaggaaagagcatccatataaagggagtgggaggtagagaaagcctggaccaggaatgagcctggtatgattgaggaaaacacaagggatttcactcttgagtgacctgggagctaatgggggattaaacagaggagggacaggatcctctatggtatatggtaagtgagtagtatggtaaatgaggtaaatgaatagtaaaaggaactgctgtggtaatttaggtaacagatgatgatggtttaggtgaaaatggttggattgtggatatggtttgattggttttagaaccaataggatttactggtggctggatgtggacaatgagagaatagaatgaaccaaagctattgtaaacgtctagaaatcagatgaggacttgaccaaaggcattggcaatgagaaagtaggcacaattcatgaggtatttcttagcattgatagagttggatataaatatctggaatttttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacactccacagtcttatcattcatagtttcttggcaaactcaccactcaaggtgtgcctcacttatttaggagatctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcaccctttctacagatgaggaaacagacaacagattggtaagtttcccaagatcacaaagtaagtcagtgggaactcaaagtaacctgactccagagcccactctcttatctaagcatatacattcccatcacaagagaacgccagtttattcaagtaaaataaggactagaaatttacatcaagaaatatattctttcaatgtagaatgctgaatggaaaaccaaatttcaatagttgcctactgaacaagatcatgagataacaacaagggagttgattataaatgactagaagttttaaatggcatcggcgctgataaagtgataatctcagctccatgatatacttgtcaagcagttacttacatcaatctgccttctaggatatcctttctcctggttgatgcttatatgatagtgttttgtacctttcctttttcactgcttccattgctgaccaaactactcacctccatatttctggtagatatattttttctcattgcatgttagtatcttaaatttagtcctatcttttgcttgatcctctgggcttgacttcctaatctatgttctggtttatgttttagtttgacagttgagctttctgaggacattcttattcccagtatctttttttgggtggttgggttctgggaggtggtatttgactgctgctgatgtgtaccaaccaagacagtagtcattaagtgactaacaataatgatttcagcagattattattactcttggcaaaaagcaagctttctctattataaatgattttatatttgttttgtttttctttatttgtaatttgagttctagcttaacattaatacttcagataactgttaatacactttcataaatcatacccacattcttgaatggcaaataaataaataatcaagttccgagtagtttctaaagagagtaaacattaaaagtaaacataaaactacataaaaatcaatcacagtctatttataaagttggtatgaaaacaaagatcctagatttggaacactcatgatactcaatattttacatatatcagagtttgtaatttccataacttcatttggtagttagacatatagacagagaagatattaatatattcattttatagtttaggaaacagacttggaagggcaaataacttgtctaagatgactaagcagctgagtgagaaccacagcctatctgtggcattcagtctcagccatctttcccttgcttcataaggatcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagagactatgaagtcaagtctggctaacttagatctggaagtttttagctgtggaaagcaattctattgtgtacaggtttcagcctgtgaagggaattcattgaaaatgcatagagatcagaagaactaacacctttcttgcatggatttttcttgattattggcagttaacaataaaatgttattagatcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctcaaattggaaaatgaatattcagatactgagtaaatttttttttttttttgagatggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgccc

SEQ ID NO: 1631 - DNA, 3798 bp, Homo sapiens
agaggacttgtcaatacaacattattctgggccatctacaatgttcttaaatctgtgtttacattttgacaagagaaaaaagaagttaagcagttaatataaatgtttttaactcaaatcacatttttagattttacttatttttctatagtcttttagaaatatttctccactcacttagctgcctctttaaaagtatgtagaacataatttaacctgttcttaatagatacaatacatcactatgacttcattatagtattatgtgattttatagggataatttttgaaggcattgcatcatacagaactgtttatttttcccatcaattgaccatggactgttactattgttgagttttatctctggctataaaatatattttgtctacatcttgtgttcagctgaaacttctccctgtataaaacttcctcaaagcagttctctcttttagttttgatgttaagacataggggactaagttttgttggggttgtgtttaaagtaggagaggagattagaaaacagcacctgaatcccttattagaggaatatctaattagttttaactaatgattctgtagcatctgatattaatttggatgtcacttgtactttgtacaacgtatttttccttattaaatgagaatgtggactagatcaactctagttattagtttcaacactatataatttatttaaattatgaactgtactatacatatagtgtttggtataattaataatacaattcatgatcatgataacaataataataatgtaataataacaaatacccatgtacccactagcagttttctgatttttgtattaaccccttgccttttgtacagtttttccacatatgtatacatctttaacatgttactttacttggctgttcttaacagtaataaaataaatataatgtgtatattctctgacttgcaattttgctgaacgttaagtatctgagtttcatctatgtggattcatattgctgtatttcagtcactttctctggtgtataatacttcatgatattaattaaccatagtttatctaatctattgttgatggattttgaaattcagttttttgctattgctagtaaagttggcataaacattctggtgcatgtccaccagcacaaatttgccaccatgtttagggtgcatacctaggagtggaattgctgagtcatagaagggtatcttttcatccgggaggcaaagacatgttgcagttactgaaacccccaccaggggcagatgaaaggcctctttgcttcatgcctctgccaacacttggtattttcatatgcttaatttgcccgcatctggtaacttctcattgtgggtttaattcgcattttcctgattgcttataagtctgaacattttttccattaatttgttagctatttgtgatgtcagcaagacaattctatgattctgtttcttcaactgagcaacatttgcttttagaccttaatattattggtagttattctgtttcttctactaagcaaccctttgcttttaggcatagatgttatcagtagtctaatgttcaggaagttgtcgcctaatactttaccatgttgactctggcctaggctttatttaagcaccttcccaaaatgtacactgattttgagttggaaaagacattcttagtcactgtaacattgttgattaccctgagcaagtcctgccatgttagtatcctgccttatcctgtttattgtgtctttatagagaatcatttacagggaagcaggatgctgggatgccaggcttaatttgaggctccttatgaatcccctgaatataatggaactaaaggataacagaaacacagagtagtaatggtagacaccaaatctgagttaaaaatcttaatatgatcatttgaatttgggtatatttccaacatggtaaaatacataggcccaatatcattgttacatttatggcatatataactgtgggtttcaaacaaacgtatgtgctttgtgcaccatcccccccaatttttgtttgggtttataattttttcacctgctcccatgggacaggctaatgaagacccctgaatgaaataaagcctcagatgtacttgcagaggcctctgtagtgtgttgccttctgtgcagactcattagagatgtgagccaaggctgagacatctaagcaaaccctctgcacccagagtcctcaatccattgttcctgcatcttttttcagtctcatgggatcccagaagaatacaaattagagagaagaatctgcaaagcttttcctttcatgtttaatgtctgggcagagctgttccctgcaggacaatttctggttattttctctctctggtttgaggcatctccagggatggtttggtgactgtttcccttggggaagttttcagcagcatatcagttttactgttaaaagtttattttacaattcatctgagatagtcctgttctaaatgttctttccattacccttgtcatctggctcttgattcctgcatacccttttcagtgacactgcctcttctgggctgaaatgtgttcaataattcgagctataaatcactctcgcctccccatttggtctttacttaaccagattataaatatttaattcatttgatttttcctcataccactccagaagcttaatcatgtttagtcttcttactttaactccctctagtttgtttatatctttcttgtaatcaaggggcctaactctgatgtgctcttctaagtaagctctccagagtcatattataaaatacaaattcagcatcatctttagcttattgtacagccatagacaaacatatggtctctcaaaacttgtgttatcagttttcaggaaggactatcaatgcctaataaaatcattgagatattataaggaccaaataagaccaagtatttcattgaagatagtacaatagttactgagcctttaccaacgattacaaatagatgaataaaagatttagatgagtttctgccctgcaggggcttttcctccagtgaaggtgacaggcacacacagaggtaggtaggatacaaggtagaacaaagtactcaccgaaaagggacacaaacagttctgttcttcatgtggtttttgtcattggttctgtttatgtgatggattacatttattgatttgcgtatgttgaaccagcctttgcagggacatggatgaagttggaaaccatcattctcagcaaactaacacaggaacagaaaaccaaacaccacatgttctcactcataagtgggaggtgaacaatgagaacatatggacacaggaaggggaacatcatcatacaccggggcctactggggagttgggggctaggggagggatagcaataggagaaataagacaggctgatggatgcagcaaaccactatggcatgtgtatacctgtgtaacaaatctgcactttctgcacatgtattccagaacttaaatataatttaaaaaactcataatatattaatatttattagctaatggactgacagagccaattcattcatccttgtatccctaaattgattggaccaaaaagaggcaagggagtttaaagagttgtcaatcatgtttaaaccaaagtattggtgtggtaagaatgaggatattatggttttgcctacagatctggtggcctgttgctgtaaaaacatctccagactttcgtgaccctttcttcccatatttcttgaatgtgttccaggtattgtgttaaggtggcaatttagctta

SEQ ID NO: 1632 - DNA, 2783 bp, Homo sapiens
agaacctgaaaaaaaaaaaccttaactgaagagaaggaagaataaaccacattgcctcaggtcactcaaatgttatataaaggaaacaccaagaaaaatgtttatattccttctctctacaggagcaaatataagaattttgcctagaaggtcaacttcatcctgtgcagcagtctggaaaatgtatcccagggcccttgaatacgctcagaattctatttgggaaggtttggttacagtgcagagctttccattttacatttatagagatattgtttattttcaaatgataagcagaaaattaaattgctctgactctgtaattcttaatgacttaatgatcttcatttagctaaatgttcccattgttttgtagttaaagcatgagagaaagaaaaaataagaaataaatgtggtcttataagtaactgttatatgtttactagtcttatcatttttctttaattttattgctaaatcaaattgagatacagccatcaccaatatttccccaacgcctattccatcacacagcccccacaccctcaacttaaataattgcattttaaagagtagggttttagttgcctccttcctaagtcaattaactctgcaataaaattaaaatacaaatatattcctgaaaaatatgcagagtgaaaagacatcttctacattataaaatttacaatagagaacttgacaaggctttttatagtagaaacatcaacaaaataacctaaaaaaaattttcaacctttcatttccttttctttgttatgaattctaattcatgtgacaatggaaatagctaattattcattctaaatttaatcagtatcttaagagctctgttcttttattcaactcttaagctgtctacagttcgattttgctggtactgtaatgaaaatgcaagagaaacatctaacacaactcagtaatagtaaccaaaaactcttttgaattttagaaaacctttttggaatacaaaaatttaagtttcttgaaaaacgtcaagataaaaaagattcaaatcatagtaatgtgagagaaaataatgtaatatctgttcctttacatcacaaggaaaatatattacactgttaatcttgttaatctttaacaaaacacagattaacaagaaaaaagcataacaaatttatttaaacaaagttatacacaagtaactttcagaaatgaagacccaaacccctagggaaagctttatatttttatgctaagtcttatcagagaagtggagaattgtggaaaaacatgattggacagagagcatagacaaatggaaataaactgggggaacttgagtaaggtctgattgttcaaataattgtctgcacctctgtatgatattccttcctgtattagtctgttctcacactgctataaagaactgcccaagactgggtagtttataaaggaaagaggtttaattgactcacagttctgcagggctggggaagcctcaggagacttgtaatcatggtggaaagggaagcaaacatatccttcttcacatggcagcaggaaggagaagaatgagagaagtgcagagtgaagtgggggaaagccactcatgaaaccatcagatctcatgagaactcactatcatgagaacagcattggggaacaacccccatggctcaatcacctcccacgaggtccctcccacaacacgtggggattacaatttgggttacaattcaagatgagatttgggtggggacacagaagcagaccatatcacttccccggctatggggcaggactcctgtcacatgagggtttcttttatggacagctctcacatagaaaggtgggagatagtcagagcgtgacctccaaaccaccacattttggtgtagcatgtcctgcaccccatcattaagtagaataattgtagcattacattagatagcacagttatacaattctgatgaaataatgatggataataactttatgaacctatttctggtactgatttttgtcctatttttatgtgtatggtaaaatatattatttggactcaataactgtatacaaacacatttgaattaagatattaatattagatacaaagcttttctacaaagtaaagagacatcaaaacctagagtgtgtcctggaagccaagtaaattaattagaggaaatcatggaaaatctcagtgtatggtacttcaaccatcttaaacgtctactgtcataagcagtatatatagatgaaagtaatgaatacagttagtgaacacaattacttatctccctgtaaaaagttattgttaacagtctttatatttataatctatatctgcatactctataataagcagtctaatacattggtcattgtattagtccattttcacactgctgataaagacataccagagactgggaagaaaaagaggtttattacagtctacatggctggggaggcctcacaatcatggcggaaggcaaggaggagcaagtcacatcttacatggatggtggcaggcaaagagagagcttgtgcaaggtaactcccctttttaaaaccatcacatcttgtgagagttattcactaccatgagaacagtatgggaaagacctgcctccatgattcaattacctcccacagggtccctcccacaacatatggtaattcaagattagattttggttgggacacagtcaaatcatatcagtcattatgcctatcattgctaaatttgcctattatttggtagaggtaagagaataaatcagaaaaagcca

SEQ ID NO: 1633 - DNA, 4746 bp, Homo sapiens
cttttcacctaggcataacatttaaaaatatttcaaaaagattcagatggcaccatgagaaaaaataaaatttgttatccttttgtttactccattcttatgctgctatggaaaaatatccgagactgagtaatttataaaggaaaaaggtttaattgactcacaagggaggcctcaggaaacttacaattatggcagaatgggaagcaaacatgtccttcttcacatggcagcaggaaggaggctaatgagtgcccagtgaagggggaagcctgttataaagccatcagatctcatgagaacttgtgcactatcatgagaacaggatgggggaaaatgctcccatgattcagttatctccacctggtccctttcatgacatgggattatgggaactacaagatgagatttgcatagggacatagccaaaccatataattcttcccctggttcctctcaaatttcatgtcctcacaattcaaaacacaatcatgcccttccaacagtctcccaaagtcttaactcattttaacattaactcaaaagttcaagtccaaagtctcatctgaggtaaggcaagtcccttccacctctgagcttgcaaaatcaaaagcaagttggttacttcctagatacaatgtgggtacaggcattgggtaaatacacctgttccaaatgggagaaagtggccaaaacaaaggagctacagtctccatgcaagtctgaaatccaacagggcagtcattaaaccttaaggttccagaatgatctcctttgactccatgtctcacgtgcaggtcttgctgatgcaagaggtgggcttccatggccttgggcagctctactgctgtggctttgcagggcacagccccctcctggctgctttcatgggctggcattgagtgccagtggctcttccaggtgcacagtgcatgctgtcatggggtctggaggatggtggccctcttctcatggttccactaggcagtgccccactggagactctgtttgcagggttccaactccacatttcccttctatactgccctagcagaagttctccatagggctctgcctttgcaggaaacttctacctgaacatccaggtgtctccatatatcttctgaaatacaggcagagctttccaaacctcaattcttgacttctatgcacccactggctcaacaacacatggaagctgccaaggcttggggcttgcatattctgatgccatggcccaagctgtaccgtagccccttttgaccatggctggagtgtctgggaaacagggcaccaagtccctaggctgcacacagcaggaggggctctgggttgggcccttgaaaccatattttcctcctaggcctccaagcctgtgatggtaggatctgctgtgaagtctctgacatgctctggagacacttttcccattgtgttgatgattaacattcagctccttgttacttaggcaaatttccatggctggcttgaatttctccccagaaaatgggttgttaatttctgttgcattggcaggctgcaacttttccaaacttttatgctctgctgttcttgaatgctttgcagcttagaaatttcttctgccagataccctaaaatcatctctctcaagttcaaaactccacagatctctagggcagggacaaaatgccaccagtctctttgcataacgagagtgacctttactccagttcccaataagttctccatctccatctgagatcacctcagcttggacttcattggtccctatcactgtcagcattttggtcaaagccattcaacaagtctctaggaagttccaaactttcccatattttcctgtcttccgagccctccaaactgttccaatctctgcctcttacccagttctaacgttacttccacattttcagtatcattataatagctgcaccttatttatgataccaatttactgtattagtccattctcatgcttctataaagatctgcccgggactgggtaatttacaaaggaaagagatttaattgactcacagttctgcaggactggggaggctttgggaaacttacaatcatggcagaaggggaagcaaatacatccttcttcacatggtggcaggaaggaaaaaaatgaatgcccagtgaagggggaagccctttataaaaccatcagatctcatgagagctaactcactatcacgagaacagggtggggaaaccacccccatgattcaattatctccacctggctcctcacatgacacatggggattcaaactaagatttgggtgaggacgcagccaaacgatatcactctgtttattaaattgttcatctacaattttgaaggagcactctctatttgtccttatttttaaactttataaaatttttatttgaggctttagagggggtattatacttttatattatgaattttttgttctaccaagaatattttatgttgacatttttaattgaaatatatggctctattttcttgtcttagaaagtaagatatactgaacatatttgaatcacattctggtgactaacagatttttacaattgttcaggataatacttgcatgtattagtatgaaaaaattctacagttgtacacaatgtcagtgattgtactggctgtgtctttcccctagaagatgccggggtgtggtgggggaggggaagaagaaaaagaaaacttaatttttatggtaagaaatcgattattattctatcctcattttaaatcatcaagtaataataagtattaaacaataataagtatttactcaattcttactatgaaccagatatttggaacatgggaatgaagcataaatcatgttctttaaactaaaagaacttggagaaatggttgcaacagcatgtgataatgcaaattatttttggcttttatattattttataaatggccaatgagccaggacaacagtgaatttcataggagttcataaaatggaaacacgaactaaaatagtttaccaacactttgggagaaaatggaaattgagttagaatttgaagaggatcttagaagataggtgatttgggaggaagtgaaaagaagggatttaagctggttctgggaaaagaaaacagcttgagtaaagatggaaatcaatgttatttttatttagtagaagataacaaatttaccttgactgaagcagaggacatgtggagcaatcacaggaaaaaaaataactttagagtttaggccacattgtagagctgaaaggcaaaagaacttggacatttacttaaccatattacaagtcctataaaaacgttttacttagtaggagaaattatacaaatgaatcaacctattcaataatacatgaaaatgaaatgactttgtttttaattgacacagaagttttctattaaggtgatgaagtgtttgcacgtgtatgtgtgcatgttcaagtatgtttgtgtgcatgtgcgtgctggagtcatcatttatcacaataaaaggttgcagctacccacctaattaggcatgaagcaagcaaagactggataaggtgatctttgtctcactttgctcctgagacatctttgtctccagtactaatcagcagtgacgcgtcaagtcatcgtgagtgacaattacagtcctctcattacaggaaatgattgcacgactaggcagattgatgagtgtattggtgttccctaagaaactgagctcctccccaccagccctcttcttgacaacattgctgaatattattaaatacatatttaaggcaattcaggtaaagcttcttcacttggcaaaacaggttatgattgcttagaaatttattctaagagcaaaatttaacacatctccctgaattgtatcttcattctgagagtctgtgcttttctgcagtgccttttcaccttcagtttgtgcaacagtacctgtgatggtgtggattaggtgttacattttgtttagacatggaaaataaaataggtagacaaagtattttgttgaagactggttagttggaagctgagtgtcagactcatttcatttcataccttgcacttccagttgcagatacctttaaataaaacatagttcacttcttcccactacaggccaatggattggctctagcccagtggtcctcaaacttgagtgagcataggaatcacctgccctatacgcaaggtttctcgttcattagttctccagtgggccccagttacttaacatttctagaaggctcccagggggtgcagatgttgatgctgaagctgggggtctggagaccaagaaccactgaagcctgtctaaaggggtaacttcttattggtcacatttcattgcccaactgttcaattccttgatgttccccagaagctttcttgcattccaatcctatatgattttgagttctttctggacacagtctgctctgttatctgaacaaacattttatctgatgctttcctttgatttttccaatcatagtctcatggtctatcaccatgagacagggattgctttaactagagaaatgataccaatactgtttgcttagattgattttctgatttactagtattcaggcattaatatgatctggtgcctgcattctcagtaacaccaatatttgtagaaccattctaagtgtaactttgatcaaactaatcagcttggtatttttttcatggatggtccagctgtcaaaatacagatgtgttcattaa

SEQ ID NO: 1634 - DNA, 17866 bp, Homo sapiens
caagtttattactgagtttattttaaaagttagtttattacttccaaagaatagaagagaaatacttttaaagtacatgtgataatatattcatataatttctaaagatcaaatcagtgtaattgggatattcatcaccttaaatatttgtctcttctttgtgctggaaacattgaaattattctcttctagctattttgaaatatataatagattattataaactataggcaccctattgagctatcaaacactaggtcttatttcttctattaaattatatatttctacccattacaaattttcctctcctccccaccccactccactgttcttcctggtctctggtaaccaccaatctactctccaccttcatagatccatttttttagctcccatatatgagtgagaatatgtgatatttgtctttctatgcttagcttatttcacttagcataatgggggcatccaattctatccatgttgttgcaaatgacaggattttactttttaatggctgaacaatattcgattgtgtatatataccacatttgctttatccattcatccattgatggagacttagcttgattccatattttggctattgcgaatagtgctgcaataaacatggaagtgcagatagctcttcagtgtactgatttgatttcttttgaatatatacctagcactgagattgctggatcatatggtagttgtagttttttagttttttgaggaaactccatatagttttccatagtgattgtactaatttacattcctacaaacatatgtatatgtttgggttccccttctctacattctcaccatcatctgatacttttttgataagcaccattttaactgggatgagatgttatctcattgtggttttgatttgcatctctgtgatgattagtgatgttgagcattttttcatgtacctgttgtccattcatatgtcttcttttgagaaatgtctattcagatcttttgtccatttttaatgagtttttttgctattgaattatttgagctccttatattctggttattaaacccttgtcagatgggtagttagcaaataatttctcccatcctgtggattgtcttttcactttgttgattgtctcctttgccgcgcagaaactttttaactcgacgtaatgccgcttttgtctatttttgctttggttgcctgtgcttttgaggtcttacacaaaaaatccttgtccagaccaatgtcctggagtgtttccccaatgttttcttctagtagtttcattgtgtcaggtcttagatttaagattttcatccatttttattttatttttgtgtatggtgagaggtagggatctagtttcattcttctacatggttgtaaactgtagtcaccctactgatctatcaaacactgggtcatacttcttctattaaactgtatgtttgtacccatcaatcaacttctctttctctcccccacccctctactcttcctgacctctagtaaccagcagtctattctctatcttcatgagatccacttttttagtttccacatgtgagtgagaacatttgatacttgttttttttcacatttgttatactcctgggctgaagtgatatataggtatgtaacactgtgcccagatggtgaataatatttttaatgtgttgttgaatttggcttgctagtattttgctgaggacttttgtatccagttttcccagcaccatttattgatgagactttcctttccccgctttgttattgatgccttcgtcaaaaataaattggctgtagccaggcacagtggctcacacctgtaattccagcacttttggaggccgaggtgggtggatcacttgagttcaggagttcgagaccagcctggtgaacatggttctactaaaaatacaaaattagccaggtatagtggcacacgcctgtagtaccagctacttgggaggctgaggcaggacaatcacttgaaaccagagggtggatattgcagtgagttgagatcgtgccactgcactccagcctgggcaacagagtgagactccatctcaaaaaataaattaataagttaaaaataaataaataaataaataaataggctataaatgcatggatttatgtctgagttctctattctgttccattggtctatgtgtctgctttttacaccagtaccatgctaatttggttactatctctttgtagtacattttaaagtcaggtagtgtgatgcctctagctttgttctttttgcttatgattgctttgggtattcagggtctttgtggttttgtataaattttagcattgttttttctgtttctatgaagaatgtcattagtattttgataagcctttctttgaatctataaattgctttgggtattactgtcgttttaacgatattcttctaatgcatgaccatggattatctttccatttttgtatgtatgtgtcctcttcaattttttttatcagtgtgttttagttttcctaatataggtctttcatttctttggtgaaattgattcctaggtattttatattttttatagctattgtaaatgggattgctttcttgatctctttttcagattgtttactgttggtgataaaatactactgatttttgtattttagttttgtatcctgcaactttactgaatttatttattagttctgacagatttttggtggggtctttaggtttttctaagtataagatcacgttgtctgtgaacaaaacaaatttgacatcttccttttcaatttggatgccctttctttctcttgcctaattcttctgtccagaattcctagtattatgttgaataaaagtgatgaaagtgtgcatccttgtcttgttctagatcttagaggaaagtcttgcaactttttttcatttagtatgatgttagctgtgagtttgtcatatatggtcttcattattttgaggtatgtttctttctttctttctttctttctttctttctttctttctttctttctttcttttctttctttctgtctctctctctgtctttcttcttcttttttttttttttaaacagggtttcacccttgttgcccagactggagtgcaatggcatggtctcggttcactaacacctccacctcccaggttcaagcagttctcctgcttcagcctcccaagtagctgggattacaggtgcctgccaccactcctggctaatttttgtatttttagtagagatggggtttcaccatgttggccaggttggtctcgaactcctgacctcaggtgatctgcccgccttggcttcccaaagtgctgggattacaggtgtgaaccactgtgcccagtgttttgaggtatgttccttctgtactcattttgttgaaggtttttatcataaagggatgctgacttttattgcatgctttttcagcatctcttgaaatgatcacatagtttttgttcttggttttgttaatgggatgtatcacatttattgatttgtgtacattgaaccatccttgcatccctgaaatgaatcccatttgatcttggggaataatttttttttttttgagacagaattttgcaatgtttcccaggttggtcttgaactcttgagctcaagtgatccccctggctcagtctcccagtagctgatactgtaggtatgtaacattgtgcccgactggtgaatgatatctttaatgtgttatggaatttggtttgctagtgttttgttgaaatttttgtgtctatgttcttcagtggtattggcctgtagttttctttttttgttctgttcttatctggttttgatattacagtaatgctgtcctcatacaatgagtttagaagtattccctcctcttcaatttttttgaagagttacagtaaaattagtattcgttctttaaatgtttggtagaattcatagtgaaaccatcaggtcctgggcttttccttgatcgtagactttttattatggcttcgattttgttattcattattggtttgttgaagttttctatttctttgttgttcaatcttggtaggttgtatagtcaaggaatttatcaattttctctaggttttccaatttgttggtgtgtaattgttcataatattctcgaatgatcctttgtatttttgtggtcttagttgttatatttccttgtatgtttctgattttatttgagtcttttctctctttttcttagtctagctaaaggtttgtctatttttgtacctttcaaaaaccaatttttcattttgtctatcttctatattttttggtctcaatttcatttatttctactctgatctttgttttggctatgaagaaatgatttttttttaaacttttaagttcaggggtacatgtgtaggtttgttacataggtaaactcatgtcatgggggtttgttggacagcttatttcatcacccaggtattaagccagtacccatgagttatttttcctgatcccttccctccttttaccctccaccatccagtaggccccactgtctgttgttcccctgtatgtgtccatgtgttctcatcatttagctcccacttatgagtgagaacatggagtatttggttttctgttcctatgtttgtttggtaaggataacggcatccagctccatgttcctgcaaaggctgcatagtattccatggtgtatatgtatcacattgtctttatccagtctaccattgatgggcatttaggttgagtttatgtctttgcttttatgaatagtgcttcagtgaatatactgtgcatgtgtctttatgatagaacaatttatattcctttggttaaatactcagtaatgagatttttgctcccatctttatttcatttcttccactaattttgtgttttgtttgctcttgcttttctagtttcttgaggtacatcgttaagttgtttatttgaagacttcctacttttctgatgtgggcttttattgctatgaactttcctgttagtactgcttttgctgtatctcatggattttggtatgttgtatttccattttcatttgtttcaagaaatttttaaatttccatctgaatttcttcattgactcattgaaaatgattgtttaatttctatgttttgtgtattttttgaggtttctctttttattgatttctagttttattccattgtggtcagaagaaatacttgatatgatttctacttttttgaatttgttgagacttcttttgtggcctaagattctggagaatctattctggagaatgtttcatgtgctgttgaaaacaatgtgtattctgcagcagctggttgaaatgttctgtaaatgtcagttaggtctgtttggtcttgtgtgtagtttaaatctgctgtgtctttgttgattttctgtctagataatctgtctactactgagagtggagtgttgaagcccttactactattacgttgcagtctatctctcccttcacatttattaatatttgctttgtatactcgaatactctagtgttgagttcatagatatttataattgttatatcctgttgatggattgactcctttatcagtatatagtgatcttctttgtcttttttagaagtctttgtagtcaatttcatctgatattaatatagctactactgctcttttttggttttcagttgcatggaatatatttttccacttccattttcagtttatgtgtgtcttaataggtgaaataggtttcttgtaggcagcatatagttgggtcttgcttctttatctattcatttgctctatgtcttttatttttactttttttttttttttttttttgagacagggtctccctctgtcacccaggctggagtgcggtggcaccatctcggctcagtgtagctcgacctttcaggctcaagcaatcctcccacctcaacctcctgagtagctgggactacaggcacatgccactgcaactggctaattttttttttatttttagtagagatggggttttgccacattgtccaggctggtcttgagctcctgaacacaagcaatttgcctgagtcagcctcccaaagtgctgggattataggtgtgagctgccgtgctcaacactctatgtcttttaattagagaattgacttcatttaaattcattgttattaatgataagtaaggattttatttttagtttttaaaatttttaaatatatttttggagacagggtcttgctctgtcactcaggctggagtgcagtggttcaatcttggcacaccacaacctctacctgccaggttcaagtgattctcgtgcctcggcctcccgagtaactggaattacaggcacatgcccctgtgcccagctaatttttgtattttagttgagatggtgtttcgccatgttggccatgctggtcttgaacttctggcctcaagtgatctgcctgcttcagccttccaaaatgctgggattataggtacaagccactgcacctagctgataagtacaggctttcaactgccattttgttgcttattttctggtggttttgtgactcctcttttcctttcttcctttcttactgttgtcctttatggctaagtggttttctctggtagcatgtttgaattcattgcttcttttttttttttaactttttaaaaatttttccgtaagttattcgggtacaggtggtatttggctacatgagtaagttctttagtggtgatttgtgagattttgttgcacccatcacccaggcagtatacattgtactctatttgtagtcttttatccctcatccccctcccagctttccccccaagtccccaaagtccattgtgtcattcttttttgttgttgttgttgttgttgttgagacagagtctcactctgtcacccaggctggagcgcagtggcacaatcttggctcactgcaacctctgcctccctggttcaagtgattctcctgcctcagcctctcccgagcagctgggactacaggggtgcaccaccacacccagctaatttttgtattttttagcagagatggggtttcaccatattggccaggctggtcttgaactgctgacctcgtgatcttcccgcctcagcctcccaaagtgctgggattataggcataagctatcatgcctggcttgtgtcattcttatgcctttgtgttctcatagcttagctcccacatatcagtgaaaacatatgatatctggtttccattcctgagttacttcacttagaataatagtctctaatctcatccaggtagctgcaaatgctgttaattcattcctctttatggctgagtagtattccatcatatatatcacagtttctttttccactcgttgattgatggcaatttgggttggttccatgattttgcaattgcgaattgtgctgctataaacatgtatgtccaagtgtcttttttgtataatgactattttcctctgggtagatccccagtagtgggattgctggatcaaatggtagttctacttttagttcttcaagaaatgtccacaccgttttccatagaggttgtactagtttacattcccaccagcagtgtagaagtgttccctgatcaccacatccacgccaacatctactgttttttttaatatatttttttattatggccattcttgcaggagtaaggtggtgttgcattgtggttttgatttgcatttccctgatcattagtgatgttgagcattttttcatgtttgttggccaattgtatatcttcttttgagaattatctattcatgtccttagctcactttttgatgggattgtttgttttttttcttactgatttgtttgagttcgttgtagattctggatattagtcctttgtcagatgtacagattgtaaagactttctccctctctgtaggttgtctgtttattctgctaaccgttccttttgccatgcaaaagctctttagtttaattaagtcccaactatttatctttgtttttattgcatttgtttttgggtttttggtgatgaaatccttgcctaagccaatgtctagaagggtttttccagtgttatcttctagaatttttatggtttcaggtcttagatttaagagttggtttttccaaggtgagagatgaggatccagtttcattctcctacatgtggccaggcaattatcccagcaccatttgttgataagggtgtcctttccccactttatgtttttgttttgtcaaagatcagttggctgtatttgggtttatttctgggttctctattctgttccattggtctatgtgccgatttttataccagtatcatgctgttttggtgactctcatgctgttttggtggtgtgatgcctccagacttgttctttttgcttagtcttgctttggctatgcgggctcttttttggttccatatgaattttagaattgtattttctaattctgtgaagaatgatggtggtattttgatggggattgcattgaatctgtagattgcttttggcagcatggtcattttcacaaatattgattctacccatccatgagcatgggatgtgtttccatttgtttgtttcatctgtgatttctttcagcagtgttttgtagtttccttgtagaggccttttgccttcttggttatgtatattcctaagttttttttttttttttttttttgcatgctattataaaaggggttgagttcttaatttgattctccacttagttgctgttggtgtataggagagctactgattttgtacattaatcttgtatccagaaggtttgctgaattcttttatcagttctaggagctttttggaagagtctttagggttttcgaggtaaacaatcatctcattggtaaacagtgacagtttgacttcctctttactgatttggatgccctttatttctttctcttgtctgattgctctggttaggacttccagtgctatgttgaagaggagtggtgagagtgggcatccttgtcttgttccaattctcagagggaatgctttcaacttttccccattcaatatcatgttggctgtgggtttgtcatagatagcttttattacattgaggtatgttccttgtatgctgattttgctgacagttttaatcataaagcgatgctggatttcttcaaatgctttttctgcatctattgagatgattgtttgatttttgtttttaattctgtttatgtggtgtatcacatttattgacttgcatatgataagccatccctgcatccctggtatgaaacccactggatcatggtggattatctttttcatatgttgttggatttagttagctagttttttgttaaggattttggcatctatgttcatcaaggatatcagtctgtagttttcttttttggttatgtcctttcctggttcatccatagaatgaattagggagggttccttctttctctatcttgtggaatagtgtcagaaagattggtaccaattcttctttgaacgtctggaagaattctgctgtgaatctgtctggtcctggacttttttttgttggtaatttttaaattaccatttcaacctcactgcttattattggtctatttagggtatctaattcttcctgatttaagctaggagggttttatctttccaggaatttatctatctcttctaggttttctagtttgtgtgtataaaggtgttcatagtagccttgaatgatcttttgtatttcattggtgtcagctgtaatatctcctgtttcatttcttaatgagattatttgaatattctctcttcttttcttggttaatcttgctaatggtctgtcaattttatttatcttttcaaagaaccatcttattgtttcatttatcttttgtattttttttgtttcaatttcatttagttctgctctgttcttggttatttcctttcttctgctgggtttgggtttggtttgttcttctttctctagttccttgagatgtgaccttagaatgtcagtttgtgctctgtcagtctttttgatgtaggtgtttaaggctatgaacttcctcttagcaccacctttgctgtatctcagaggttttgataggttgtatcattattgtctttcagttcaaagaatttttaaatttccgtcttgatttcatttttgatgcaatgctcattcaggagcagtttatttaatttccacatacttgcatggttttgaaggttccttttggaattgatttacagttttattccactgtggtctgagaggctgcttgatgtaatattaattttcttaaatttattgaagcttgttttatggcctatcatggtctatcttggagaaaggtccatgtgctattgaatagaatgtgcattctgtagttgttggatgaaatgttctgtatgtatctgttaagtccatttgttctaagatataggttaaatccattgcttctttgttgactttttgtcttgatgacctgtccagtgctgtcagtggagaactgaagtcccccactattattgtgttgctgtctatctcattgcttaggtctattagtaattagtaaatttgggacctccagtgttaagtgcatatatgtttaggattgtgatatcttcctgctggacaaggccttttaccattatataatgtccctctttgtctcttttaactgctgttgctttaaagtttgttttgtctgatataagagtagctacccctgcttgcttttggtgtccatttgcatgaaatgccttttcccacccctttactttaggtttatgtgggtccttatgtgtgagtctcctgaaggtagcaggtggttggtgagttcttatcaattctccagttctatatgttttaagcggaacatttaggccatttacatttaatgttagtgttgagatgtgaggtaccattacattcgtaatgttatttgttgtctgtgttccttgtttttgtttttgctttttaacatgtatttttgtataggtcctgtgtgatttatactttaaagaggttctgttttgatgtgtttccagtatttgttttaagatttagatctccttttagcagatcttatagtggaggcttagtagtggcgaattctctcagcattcgtttgtctgaaaaagactgtatctttccttcatatctgatgcttagtttctctggatacgaaatccttggctgataattgttttgtttgaggaggctgaagatagggccccaatcccttctagcttatagggtttctgctgagaaatctgctgttagtctgataggttttcctttataggctatctggtacttttgtctcacagctcttaagattctttccttcatcttaactctagataacctgatgacagtttgcctaggcaatgatctttttgtgttgaatttctcaggtgttctttgtgcttcttgtatttggatgtccaggtctctagcaaggctggggaagttttcctcgatttttcccccaaatatgttttccaaacttttagatttctcttcttcctcaggaatactgattattcttaggtttggtcgtttaacataatcccagacttcttggaggctttgttcatattttattattcttttttctttgtttttgttggattgggttaattcgaagatgttgtctttgaactctgaatttctttcttctgcttgttcaattatgttgctgagacttaccagagcattttgcatttctataagtgtgtccaatttttcctgaatgttttattgttttttctttatgttatctatttccttgaatatttctcccttcacttcttgtatcgttttttggatttccttgcattgggcttcgcctttctctggtgcctccctgataagcttaataactaacctcctgaaatctgtttcaggtaaatcagggatttcttcttggtttggatccattgctggtgaactagtgtgattttttggggttgttaaagagccttgttttgtcatattaccagagttggttttctggttccttcttatttgggtaggctctgtcagagggaaagtctagggctgaaggctgttgttcagattctcttgtcccacagggtgttcctttgatatagtactctcccccttttcctatggatgtggcttcctgtgagctgaactacagtgattgttctctctcttctgggtctagccacccagcaagtctacccagctctgggctggtacggggggttgtctggatagagtcctatgatgtgaaccatctgtgggtctctcagccgtggataccagtgcctgttccggtggaggtgacggttggtggtggggtcggggtgggggttgaaatggactctgtgagagtttttagctttggtggtttaatgctctatttttgtgttggttggcctcctgccaggtggtggatggggccctagaactccccaaattatatgctctttgtcttcagctaccagggtgggtagggaaggaccatcaggtagggggcatggctaggcatgtctgagctcagactgtccttgggtgggtcttgctgcagctgctgtgggagatgggggtgaggttcccaggtaagtggagttgtgtacctaggaggattatggctgcctctggtgagtcatgcaggttgtcagggaagttggggaaagctggcagtcacaggcctcacccagctcccatgcaaaccaaagggccagtctcattcccactgtgccccacccagtagtctgtttccatgtgatgggcgagctaggcttgagaacttgccccaggctgcccacctcccagctgagaaagaaaagggcttggttcttcccccttctgtggagactgcacactggattcatgccctctgcccgagttctggccaggaggcttctcaccaccagttcaaattgttacaaacttcagctgaagatttccttctccccgtggtgtttttccccactcctctggccgcccttctgatggatccctgtggtgccaggcaggaatggcctgcctgggaacccagcgagttcccagggcctttcccactgcttcctctacccctatatttcgctcagctctctaaattgactcagctccaggtaaggtcagaaatttctcccacaaacagacctccagtttctgcagtgggggtatgtatttgggagaggaggatctccctttcccactttcacagttggggcactcacagtatttgggctgtctcccgggttctgcaggaggcagtctgcttccttcagagggtctgcgggtcctttcaagattgctggtttgtttttgccattgatctggagctaaaattcacaatgcaagcctctgcacgctgctttatccatccgagttgaagctgcaatctagtcctgcctcccgtccgccatgatgatccaaactattgcttacttttctgctttttatttttagtgtatctatgataggtttttgcattatagttgccatgaggcctatgaaaaacaccttacagaaataacacattatttttaaaagatgacagcttaccttcgatcacaaaaaataaaatcaaagaaaaatctagaaaaaagctctatactttaactccattccccaagattttgacttttggttatctcaatttacatatttttatactatctatctcttaacaagttgttataactattattataattgttataactattattataatagttataactattattgtttttgacagatttttcttttggacttcatactagagttatgaatagattgcactccccaaggacagtattagaatattttgggtttgtccatgtacttaattttaccagtatgttttataccttcagatgtcttctttttgtacaaatcattggtttcattttctttcagattgaagaactccctttcacatttcttgtaagatgggtctgtttgtcgtgaattctctcaagttttgtttatttgggaaagccttttatctttccttcatatttaaaggacaagtttgctggatacagtattctccaaaggaagttttttaatttcagcaattttgaaaatgtcatctcactcccacctgccctgtatggtttctgtgaagaagtctgttgccagatgaattggagctctgtacttgcttcttttcccttgctgcttttaggatcctctctttattcttgacttttgatcagtttattatatgccttgggggagtcttatttgagtcacatctgtttgatgctctctcatcttcctgtacctggatatttatctctttctcaaattttggaaagttttttttttttttaataaactttctacccctattcttgctcaactccttgaacaccaataattcttagatttgtttttttcaggtaattttctgtatcttatagacagtctttgttggttttcattcttttctcttttttgtcctctgattatgtattttcaaatagcctgtctttgagctcactgattctttcctctgcttgatccattctgctcttgagggcctccagtgaatttttcagtttatttgctacattttcagtagcaaatgtatttgtcagttccaagatagccacttgattttttaaattgttatttcaattattttgttaaatttatctgataaatttatgaattgctcttttgtgttatcttaaagatcactgagtagccgggcgcgatggcttacacctgtaatcacaacactttgggaggccaaggcgggcagatcatgaggtcaggagtttgagaccagcctggccaacatggtgaaaccccgtctctactaaagatacaaaaaattagccgggtgtggtggtacgtgcctgtaatcccagctactcaggaggctgaggcaggagaaccacttgaacctgggaggcagaggttgcagtgagctgagatcatgccattgtacttcagcctgggtgacagggcgagactctgtctcagaaataaaaaaaaaagatcactgagtttccttaaaactgctattttgaattcttgatcatagagctcacatattgccgtcttattagggtcagtcactggctccttgctttatcaatttgagaggaccatagttccatgtttcctgatgtttcttgtggtgtgtgtttatgtcttgcattgaaggacagttcaattgaaggacagttgaagttatttgttccattctccctctggcttgttttttattgggatatttgcttatagattctgtgtaatttacctgctgactttcttttttttccccctgctaggtagctgcctcctttttggcactagatggcactttaagcccaggtttgcatcaattctagcaaacagtcagagtgccacccatcctgaatggaggaggtcccaaagggatatcccagtagtgtgggaaggctagctaggggttcatgcccaggggacctgtggaacaaatctcctacagtgtggtgctgctgaactgccatgctaatttggagtctcctttggttgagttacagagcagaatttccatggctgaggatgatagtcccacctccccactttgtttctggctgtgtttagggatatttctttcttcaagtatacctgatgccttccatgagttgaggcaggaaccgatctcctgccagggaacccaagatagtagggaagctggttgtccacctcaatatcagtttgctgtgtagaaactgtgagttgagggaaattttccatacacttgtactgggcagattgggggaaagtgtgtcatagatacagaagtctgattctcttaccatctactcagtttttacacttctctgtggctctaggaactgtctctttctcatatttgagttctgggatattgctggtaataacctgggtgctgtgtatttgtttttgtttttttgtggatggggagggggagtaaagccagcttgcttctacactgccattttggaacctgaagtttttgtgggaaggtttttaattgcagtttataatttaaattgttatatacctatttgttatatttggtagttcataatttttatatgaatatatacattttctttacattttcaaacgcattaggataaagttgaagccattttcatttttctcttattcaacttttaatgttcaaagtagtaatgttgcctttttcagttttcatgatattgagtatttgtgttcattttctcttcttaaacagtcttactggtggtttatcaattttattagtcttttcaaaaaatcaacttttggcttgtttgatccttctctataatttgttaccaagtttatttcttttctttcctttattagttccccttttgtattcctgggcttatttgatgtttttttaatatatatatattttaagtagactcttaactcattgatttttcagcttttcttccatactaatataagtatttaaactataaatatccttctattcttggtcttagctgcaacccacaagttttggtatgtaactaatgtatgtattatcaatatgtttgaaatttcattttatatattctttgacttacgagttatttaaaatattatttatttattaacatgggaatgttcttgtttttttatttttaattgtggtactctttcaacaaatttttaagtgttcaatgcaaaattgttaactataggtagatgttgtacagcagatctctagaactaacttatcttgtgtaaatgaaaggttatacctatttaatagcaactccccattttcccctcttctcaggctcctagcaactaccattctactctctgcttctattaatttcactattttagataccttataaaagtggaattgtgtattatttgttctgtgcctggcttatttcacataacatagtgtcttcaaatttcatccatattgttatatattgcagattttccttccttttaaaagctgaataataatagtctgttgtatatatatatatgccacattttctttatccatccaggatatcctcgttttttgttttgttttgttttttactaggctttagtttaattgcattgcagtcagagaacctactctgtgtgtttttaattcttccaactttgttaagcatatgttccatttttgtaaggattccttgagtccatggaaatagtgtgaatcccataatttttaggttcagtgttctgtataaatcagtcatatttgctaataatgtcatattttatccttattaatattatcacttttttgagcagttcatgagaggtgtgttaaaatctcctgctttgattatggatttattgactcctactcataggctgtctatcatttttttcattatagattttaagtctatgttatttaaggcataatttttaaattattctatcttccttgaaattttgatcagttatgaagtttccttctttagtgatgtttttgtcttgaagtctactttttctgattttaatatggccacatcagctttctttgatttttacttacatgccatatttttttcctgtccttctatttttaccctttctattttcttatattttagatgtgttgcccataaacagcattgagtttggtaggctttgtttttaatctagtgtcataattattgtcttttaattagagtatttagtccatttacatttaatgttcttatgggtttttatctaccatcttactttctacatgtcctctatattcctgtgtttcatttatggtactatttattggtgttttattctttcttactatcaccagtgatatgttaatttaattggcattttcaaaga

SEQ ID NO: 1635 - DNA, 17805 bp, Homo sapiens
caagtttattactgagtttattttaaaagttagtttattacttccaaagaatagaagagaaatacttttaaagtacatgtgataatatattcatataatttctaaagatcaaatcagtgtaattgggatattcatcaccttaaatatttgtctcttctttgtgctggaaacattgaaattattctcttctagctattttgaaatatataatagattattataaactataggcaccctattgagctatcaaacactaggtcttatttcttctattaaattatatatttctacccattacaaattttcctctcctccccaccccactccactgttcttcctggtctctggtaaccaccaatctactctccaccttcatagatccatttttttagctcccatatatgagtgagaatatgtgatatttgtctttctatgcttagcttatttcacttagcataatgggggcatccaattctatccatgttgttgcaaatgacaggattttactttttaatggctgaacaatattcgattgtgtatatataccacatttgctttatccattcatccattgatggagacttagcttgattccatattttggctattgcgaatagtgctgcaataaacatggaagtgcagatagctcttcagtgtactgatttgatttcttttgaatatatacctagcactgagattgctggatcatatggtagttgtagttttttagttttttgaggaaactccatatagttttccatagtgattgtactaatttacattcctacaaacatatgtatatgtttgggttccccttctctacattctcaccatcatctgatacttttttgataagcaccattttaactgggatgagatgttatctcattgtggttttgatttgcatctctgtgatgattagtgatgttgagcattttttcatgtacctgttgtccattcatatgtcttcttttgagaaatgtctattcagatcttttgtccatttttaatgagtttttttgctattgaattatttgagctccttatattctggttattaaacccttgtcagatgggtagttagcaaataatttctcccatcctgtggattgtcttttcactttgttgattgtctcctttgccgcgcagaaactttttaactcgacgtaatgccgcttttgtctatttttgctttggttgcctgtgcttttgaggtcttacacaaaaaatccttgtccagaccaatgtcctggagtgtttccccaatgttttcttctagtagtttcattgtgtcaggtcttagatttaagattttcatccatttttattttatttttgtgtatggtgagaggtagggatctagtttcattcttctacatggttgtaaactgtagtcaccctactgatctatcaaacactgggtcatacttcttctattaaactgtatgtttgtacccatcaatcaacttctctttctctcccccacccctctactcttcctgacctctagtaaccagcagtctattctctatcttcatgagatccacttttttagtttccacatgtgagtgagaacatttgatacttgttttttttcacatttgttatactcctgggctgaagtgatatataggtatgtaacactgtgcccagatggtgaataatatttttaatgtgttgttgaatttggcttgctagtattttgctgaggacttttgtatccagttttcccagcaccatttattgatgagactttcctttccccgctttgttattgatgccttcgtcaaaaataaattggctgtagccaggcacagtggctcacacctgtaattccagcacttttggaggccgaggtgggtggatcacttgagttcaggagttcgagaccagcctggtgaacatggttctactaaaaatacaaaattagccaggtatagtggcacacgcctgtagtaccagctacttgggaggctgaggcaggacaatcacttgaaaccagagggtggatattgcagtgagttgagatcgtgccactgcactccagcctgggcaacagagtgagactccatctcaaaaaataaattaataagttaaaaataaataaataaataaataaataggctataaatgcatggatttatgtctgagttctctattctgttccattggtctatgtgtctgctttttacaccagtaccatgctaatttggttactatctctttgtagtacattttaaagtcaggtagtgtgatgcctctagctttgttctttttgcttatgattgctttgggtattcagggtctttgtggttttgtataaattttagcattgttttttctgtttctatgaagaatgtcattagtattttgataagcctttctttgaatctataaattgctttgggtattactgtcgttttaacgatattcttctaatgcatgaccatggattatctttccatttttgtatgtatgtgtcctcttcaattttttttatcagtgtgttttagttttcctaatataggtctttcatttctttggtgaaattgattcctaggtattttatattttttatagctattgtaaatgggattgctttcttgatctctttttcagattgtttactgttggtgataaaatactactgatttttgtattttagttttgtatcctgcaactttactgaatttatttattagttctgacagatttttggtggggtctttaggtttttctaagtataagatcacgttgtctgtgaacaaaacaaatttgacatcttccttttcaatttggatgccctttctttctcttgcctaattcttctgtccagaattcctagtattatgttgaataaaagtgatgaaagtgtgcatccttgtcttgttctagatcttagaggaaagtcttgcaactttttttcatttagtatgatgttagctgtgagtttgtcatatatggtcttcattattttgaggtatgtttctttctttctttctttctttctttctttctttctttctttctttctttcttttctttctttctgtctctctctctgtctttcttcttcttttttttttttttaaacagggtttcacccttgttgcccagactggagtgcaatggcatggtctcggttcactaacacctccacctcccaggttcaagcagttctcctgcttcagcctcccaagtagctgggattacaggtgcctgccaccactcctggctaatttttgtatttttagtagagatggggtttcaccatgttggccaggttggtctcgaactcctgacctcaggtgatctgcccgccttggcttcccaaagtgctgggattacaggtgtgaaccactgtgcccagtgttttgaggtatgttccttctgtactcattttgttgaaggtttttatcataaagggatgctgacttttattgcatgctttttcagcatctcttgaaatgatcacatagtttttgttcttggttttgttaatgggatgtatcacatttattgatttgtgtacattgaaccatccttgcatccctgaaatgaatcccatttgatcttggggaataatttttttttttttgagacagaattttgcaatgtttcccaggttggtcttgaactcttgagctcaagtgatccccctggctcagtctcccagtagctgatactgtaggtatgtaacattgtgcccgactggtgaatgatatctttaatgtgttatggaatttggtttgctagtgttttgttgaaatttttgtgtctatgttcttcagtggtattggcctgtagttttctttttttgttctgttcttatctggttttgatattacagtaatgctgtcctcatacaatgagtttagaagtattccctcctcttcaatttttttgaagagttacagtaaaattagtattcgttctttaaatgtttggtagaattcatagtgaaaccatcaggtcctgggcttttccttgatcgtagactttttattatggcttcgattttgttattcattattggtttgttgaagttttctatttctttgttgttcaatcttggtaggttgtatagtcaaggaatttatcaattttctctaggttttccaatttgttggtgtgtaattgttcataatattctcgaatgatcctttgtatttttgtggtcttagttgttatatttccttgtatgtttctgattttatttgagtcttttctctctttttcttagtctagctaaaggtttgtctatttttgtacctttcaaaaaccaatttttcattttgtctatcttctatattttttggtctcaatttcatttatttctactctgatctttgttttggctatgaagaaatgatttttttttaaacttttaagttcaggggtacatgtgtaggtttgttacataggtaaactcatgtcatgggggtttgttggacagcttatttcatcacccaggtattaagccagtacccatgagttatttttcctgatcccttccctccttttaccctccaccatccagtaggccccactgtctgttgttcccctgtatgtgtccatgtgttctcatcatttagctcccacttatgagtgagaacatggagtatttggttttctgttcctatgtttgtttggtaaggataacggcatccagctccatgttcctgcaaaggctgcatagtattccatggtgtatatgtatcacattgtctttatccagtctaccattgatgggcatttaggttgagtttatgtctttgcttttatgaatagtgcttcagtgaatatactgtgcatgtgtctttatgatagaacaatttatattcctttggttaaatactcagtaatgagatttttgctcccatctttatttcatttcttccactaattttgtgttttgtttgctcttgcttttctagtttcttgaggtacatcgttaagttgtttatttgaagacttcctacttttctgatgtgggcttttattgctatgaactttcctgttagtactgcttttgctgtatctcatggattttggtatgttgtatttccattttcatttgtttcaagaaatttttaaatttccatctgaatttcttcattgactcattgaaaatgattgtttaatttctatgttttgtgtattttttgaggtttctctttttattgatttctagttttattccattgtggtcagaagaaatacttgatatgatttctacttttttgaatttgttgagacttcttttgtggcctaagattctggagaatctattctggagaatgtttcatgtgctgttgaaaacaatgtgtattctgcagcagctggttgaaatgttctgtaaatgtcagttaggtctgtttggtcttgtgtgtagtttaaatctgctgtgtctttgttgattttctgtctagataatctgtctactactgagagtggagtgttgaagcccttactactattacgttgcagtctatctctcccttcacatttattaatatttgctttgtatactcgaatactctagtgttgagttcatagatatttataattgttatatcctgttgatggattgactcctttatcagtatatagtgatcttctttgtcttttttagaagtctttgtagtcaatttcatctgatattaatatagctactactgctcttttttggttttcagttgcatggaatatatttttccacttccattttcagtttatgtgtgtcttaataggtgaaataggtttcttgtaggcagcatatagttgggtcttgcttctttatctattcatttgctctatgtcttttatttttactttttttttttttttttttttgagacagggtctccctctgtcacccaggctggagtgcggtggcaccatctcggctcagtgtagctcgacctttcaggctcaagcaatcctcccacctcaacctcctgagtagctgggactacaggcacatgccactgcaactggctaattttttttttatttttagtagagatggggttttgccacattgtccaggctggtcttgagctcctgaacacaagcaatttgcctgagtcagcctcccaaagtgctgggattataggtgtgagctgccgtgctcaacactctatgtcttttaattagagaattgacttcatttaaattcattgttattaatgataagtaaggattttatttttagtttttaaaatttttaaatatatttttggagacagggtcttgctctgtcactcaggctggagtgcagtggttcaatcttggcacaccacaacctctacctgccaggttcaagtgattctcgtgcctcggcctcccgagtaactggaattacaggcacatgcccctgtgcccagctaatttttgtattttagttgagatggtgtttcgccatgttggccatgctggtcttgaacttctggcctcaagtgatctgcctgcttcagccttccaaaatgctgggattataggtacaagccactgcacctagctgataagtacaggctttcaactgccattttgttgcttattttctggtggttttgtgactcctcttttcctttcttcctttcttactgttgtcctttatggctaagtggttttctctggtagcatgtttgaattcattgcttcttttttttttttaactttttaaaaatttttccgtaagttattcgggtacaggtggtatttggctacatgagtaagttctttagtggtgatttgtgagattttgttgcacccatcacccaggcagtatacattgtactctatttgtagtcttttatccctcatccccctcccagctttccccccaagtccccaaagtccattgtgtcattcttttttgttgttgttgttgttgttgttgagacagagtctcactctgtcacccaggctggagcgcagtggcacaatcttggctcactgcaacctctgcctccctggttcaagtgattctcctgcctcagcctctcccgagcagctgggactacaggggtgcaccaccacacccagctaatttttgtattttttagcagagatggggtttcaccatattggccaggctggtcttgaactgctgacctcgtgatcttcccgcctcagcctcccaaagtgctgggattataggcataagctatcatgcctggcttgtgtcattcttatgcctttgtgttctcatagcttagctcccacatatcagtgaaaacatatgatatctggtttccattcctgagttacttcacttagaataatagtctctaatctcatccaggtagctgcaaatgctgttaattcattcctctttatggctgagtagtattccatcatatatatcacagtttctttttccactcgttgattgatggcaatttgggttggttccatgattttgcaattgcgaattgtgctgctataaacatgtatgtccaagtgtcttttttgtataatgactattttcctctgggtagatccccagtagtgggattgctggatcaaatggtagttctacttttagttcttcaagaaatgtccacaccgttttccatagaggttgtactagtttacattcccaccagcagtgtagaagtgttccctgatcaccacatccacgccaacatctactgttttttttaatatatttttttattatggccattcttgcaggagtaaggtggtgttgcattgtggttttgatttgcatttccctgatcattagtgatgttgagcattttttcatgtttgttggccaattgtatatcttcttttgagaattatctattcatgtccttagctcactttttgatgggattgtttgttttttttcttactgatttgtttgagttcgttgtagattctggatattagtcctttgtcagatgtacagattgtaaagactttctccctctctgtaggttgtctgtttattctgctaaccgttccttttgccatgcaaaagctctttagtttaattaagtcccaactatttatctttgtttttattgcatttgtttttgggtttttggtgatgaaatccttgcctaagccaatgtctagaagggtttttccagtgttatcttctagaatttttatggtttcaggtcttagatttaagagttggtttttccaaggtgagagatgaggatccagtttcattctcctacatgtggccaggcaattatcccagcaccatttgttgataagggtgtcctttccccactttatgtttttgttttgtcaaagatcagttggctgtatttgggtttatttctgggttctctattctgttccattggtctatgtgccgatttttataccagtatcatgctgttttggtgactctcatgctgttttggtggtgtgatgcctccagacttgttctttttgcttagtcttgctttggctatgcgggctcttttttggttccatatgaattttagaattgtattttctaattctgtgaagaatgatggtggtattttgatggggattgcattgaatctgtagattgcttttggcagcatggtcattttcacaaatattgattctacccatccatgagcatgggatgtgtttccatttgtttgtttcatctgtgatttctttcagcagtgttttgtagtttccttgtagaggccttttgccttcttggttatgtatattcctaagttttttttttttttttttttttgcatgctattataaaaggggttgagttcttaatttgattctccacttagttgctgttggtgtataggagagctactgattttgtacattaatcttgtatccagaaggtttgctgaattcttttatcagttctaggagctttttggaagagtctttagggttttcgaggtaaacaatcatctcattggtaaacagtgacagtttgacttcctctttactgatttggatgccctttatttctttctcttgtctgattgctctggttaggacttccagtgctatgttgaagaggagtggtgagagtgggcatccttgtcttgttccaattctcagagggaatgctttcaacttttccccattcaatatcatgttggctgtgggtttgtcatagatagcttttattacattgaggtatgttccttgtatgctgattttgctgacagttttaatcataaagcgatgctggatttcttcaaatgctttttctgcatctattgagatgattgtttgatttttgtttttaattctgtttatgtggtgtatcacatttattgacttgcatatgataagccatccctgcatccctggtatgaaacccactggatcatggtggattatctttttcatatgttgttggatttagttagctagttttttgttaaggattttggcatctatgttcatcaaggatatcagtctgtagttttcttttttggttatgtcctttcctggttcatccatagaatgaattagggagggttccttctttctctatcttgtggaatagtgtcagaaagattggtaccaattcttctttgaacgtctggaagaattctgctgtgaatctgtctggtcctggacttttttttgttggtaatttttaaattaccatttcaacctcactgcttattattggtctatttagggtatctaattcttcctgatttaagctaggagggttttatctttccaggaatttatctatctcttctaggttttctagtttgtgtgtataaaggtgttcatagtagccttgaatgatcttttgtatttcattggtgtcagctgtaatatctcctgtttcatttcttaatgagattatttgaatattctctcttcttttcttggttaatcttgctaatggtctgtcaattttatttatcttttcaaagaaccatcttattgtttcatttatcttttgtattttttttgtttcaatttcatttagttctgctctgttcttggttatttcctttcttctgctgggtttgggtttggtttgttcttctttctctagttccttgagatgtgaccttagaatgtcagtttgtgctctgtcagtctttttgatgtaggtgtttaaggctatgaacttcctcttagcaccacctttgctgtatctcagaggttttgataggttgtatcattattgtctttcagttcaaagaatttttaaatttccgtcttgatttcatttttgatgcaatgctcattcaggagcagtttatttaatttccacatacttgcatggttttgaaggttccttttggaattgatttacagttttattccactgtggtctgagaggctgcttgatgtaatattaattttcttaaatttattgaagcttgttttatggcctatcatggtctatcttggagaaaggtccatgtgctattgaatagaatgtgcattctgtagttgttggatgaaatgttctgtatgtatctgttaagtccatttgttctaagatataggttaaatccattgcttctttgttgactttttgtcttgatgacctgtccagtgctgtcagtggagaactgaagtcccccactattattgtgttgctgtctatctcattgcttaggtctattagtaattagtaaatttgggacctccagtgttaagtgcatatatgtttaggattgtgatatcttcctgctggacaaggccttttaccattatataatgtccctctttgtctcttttaactgctgttgctttaaagtttgttttgtctgatataagagtagctacccctgcttgcttttggtgtccatttgcatgaaatgccttttcccacccctttactttaggtttatgtgggtccttatgtgtgagtctcctgaaggtagcaggtggttggtgagttcttatcaattctccagttctatatgttttaagcggaacatttaggccatttacatttaatgttagtgttgagatgtgaggtaccattacattcgtaatgttatttgttgtctgtgttccttgtttttgtttttgctttttaacatgtatttttgtataggtcctgtgtgatttatactttaaagaggttctgttttgatgtgtttccagtatttgttttaagatttagatctccttttagcagatcttatagtggaggcttagtagtggcgaattctctcagcattcgtttgtctgaaaaagactgtatctttccttcatatctgatgcttagtttctctggatacgaaatccttggctgataattgttttgtttgaggaggctgaagatagggccccaatcccttctagcttatagggtttctgctgagaaatctgctgttagtctgataggttttcctttataggctatctggtacttttgtctcacagctcttaagattctttccttcatcttaactctagataacctgatgacagtttgcctaggcaatgatctttttgtgttgaatttctcaggtgttctttgtgcttcttgtatttggatgtccaggtctctagcaaggctggggaagttttcctcgatttttcccccaaatatgttttccaaacttttagatttctcttcttcctcaggaatactgattattcttaggtttggtcgtttaacataatcccagacttcttggaggctttgttcatattttattattcttttttctttgtttttgttggattgggttaattcgaagatgttgtctttgaactctgaatttctttcttctgcttgttcaattatgttgctgagacttaccagagcattttgcatttctataagtgtgtccaatttttcctgaatgttttattgttttttctttatgttatctatttccttgaatatttctcccttcacttcttgtatcgttttttggatttccttgcattgggcttcgcctttctctggtgcctccctgataagcttaataactaacctcctgaaatctgtttcaggtaaatcagggatttcttcttggtttggatccattgctggtgaactagtgtgattttttggggttgttaaagagccttgttttgtcatattaccagagttggttttctggttccttcttatttgggtaggctctgtcagagggaaagtctagggctgaaggctgttgttcagattctcttgtcccacagggtgttcctttgatatagtactctcccccttttcctatggatgtggcttcctgtgagctgaactacagtgattgttctctctcttctgggtctagccacccagcaagtctacccagctctgggctggtacggggggttgtctggatagagtcctatgatgtgaaccatctgtgggtctctcagccgtggataccagtgcctgttccggtggaggtgacggttggtggtggggtcggggtgggggttgaaatggactctgtgagagtttttagctttggtggtttaatgctctatttttgtgttggttggcctcctgccaggtggtggatggggccctagaactccccaaattatatgctctttgtcttcagctaccagggtgggtagggaaggaccatcaggtagggggcatggctaggcatgtctgagctcagactgtccttgggtgggtcttgctgcagctgctgtgggagatgggggtgaggttcccaggtaagtggagttgtgtacctaggaggattatggctgcctctggtgagtcatgcaggttgtcagggaagttggggaaagctggcagtcacaggcctcacccagctcccatgcaaaccaaagggccagtctcattcccactgtgccccacccagtagtctgtttccatgtgatgggcgagctaggcttgagaacttgccccaggctgcccacctcccagctgagaaagaaaagggcttggttcttcccccttctgtggagactgcacactggattcatgccctctgcccgagttctggccaggaggcttctcaccaccagttcaaattgttacaaacttcagctgaagatttccttctccccgtggtgtttttccccactcctctggccgcccttctgatggatccctgtggtgccaggcaggaatggcctgcctgggaacccagcgagttcccagggcctttcccactgcttcctctacccctatatttcgctcagctctctaaattgactcagctccaggtaaggtcagaaatttctcccacaaacagacctccagtttctgcagtgggggtatgtatttgggagaggaggatctccctttcccactttcacagttggggcactcacagtatttgggctgtctcccgggttctgcaggaggcagtctgcttccttcagagggtctgcgggtcctttcaagattgctggtttgtttttgccattgatctggagctaaaattcacaatgcaagcctctgcacgctgctttatccatccgagttgaagctgcaatctagtcctgcctcccgtccgccatgatgatccaaactattgcttacttttctgctttttatttttagtgtatctatgataggtttttgcattatagttgccatgaggcctatgaaaaacaccttacagaaataacacattatttttaaaagatgacagcttaccttcgatcacaaaaaataaaatcaaagaaaaatctagaaaaaagctctatactttaactccattccccaagattttgacttttggttatctcaatttacatatttttatactatctatctcttaacaagttgttataactattattataattgttataactattattataatagttataactattattgtttttgacagatttttcttttggacttcatactagagttatgaatagattgcactccccaaggacagtattagaatattttgggtttgtccatgtacttaattttaccagtatgttttataccttcagatgtcttctttttgtacaaatcattggtttcattttctttcagattgaagaactccctttcacatttcttgtaagatgggtctgtttgtcgtgaattctctcaagttttgtttatttgggaaagccttttatctttccttcatatttaaaggacaagtttgctggatacagtattctccaaaggaagttttttaatttcagcaattttgaaaatgtcatctcactcccacctgccctgtatggtttctgtgaagaagtctgttgccagatgaattggagctctgtacttgcttcttttcccttgctgcttttaggatcctctctttattcttgacttttgatcagtttattatatgccttgggggagtcttatttgagtcacatctgtttgatgctctctcatcttcctgtacctggatatttatctctttctcaaattttggaaagttttttttttttttaataaactttctacccctattcttgctcaactccttgaacaccaataattcttagatttgtttttttcaggtaattttctgtatcttatagacagtctttgttggttttcattcttttctcttttttgtcctctgattatgtattttcaaatagcctgtctttgagctcactgattctttcctctgcttgatccattctgctcttgagggcctccagtgaatttttcagtttatttgctacattttcagtagcaaatgtatttgtcagttccaagatagccacttgattttttaaattgttatttcaattattttgttaaatttatctgataaatttatgaattgctcttttgtgttatcttaaagatcactgagtagccgggcgcgatggcttacacctgtaatcacaacactttgggaggccaaggcgggcagatcatgaggtcaggagtttgagaccagcctggccaacatggtgaaaccccgtctctactaaagatacaaaaaattagccgggtgtggtggtacgtgcctgtaatcccagctactcaggaggctgaggcaggagaaccacttgaacctgggaggcagaggttgcagtgagctgagatcatgccattgtacttcagcctgggtgacagggcgagactctgtctcagaaataaaaaaaaaagatcactgagtttccttaaaactgctattttgaattcttgatcatagagctcacatattgccgtcttattagggtcagtcactggctccttgctttatcaatttgagaggaccatagttccatgtttcctgatgtttcttgtggtgtgtgtttatgtcttgcattgaaggacagttcaattgaaggacagttgaagttatttgttccattctccctctggcttgttttttattgggatatttgcttatagattctgtgtaatttacctgctgactttcttttttttccccctgctaggtagctgcctcctttttggcactagatggcactttaagcccaggtttgcatcaattctagcaaacagtcagagtgccacccatcctgaatggaggaggtcccaaagggatatcccagtagtgtgggaaggctagctaggggttcatgcccaggggacctgtggaacaaatctcctacagtgtggtgctgctgaactgccatgctaatttggagtctcctttggttgagttacagagcagaatttccatggctgaggatgatagtcccacctccccactttgtttctggctgtgtttagggatatttctttcttcaagtatacctgatgccttccatgagttgaggcaggaaccgatctcctgccagggaacccaagatagtagggaagctggttgtccacctcaatatcagtttgctgtgtagaaactgtgagttgagggaaattttccatacacttgtactgggcagattgggggaaagtgtgtcatagatacagaagtctgattctcttaccatctactcagtttttacacttctctgtggctctaggaactgtctctttctcatatttgagttctgggatattgctggtaataacctgggtgctgtgtatttgtttttgtttttttgtggatggggagggggagtaaagccagcttgcttctacactgccattttggaacctgaagtttttgtgggaaggtttttaattgcagtttataatttaaattgttatatacctatttgttatatttggtagttcataatttttatatgaatatatacattttctttacattttcaaacgcattaggataaagttgaagccattttcatttttctcttattcaacttttaatgttcaaagtagtaatgttgcctttttcagttttcatgatattgagtatttgtgttcattttctcttcttaaacagtcttactggtggtttatcaattttattagtcttttcaaaaaatcaacttttggcttgtttgatccttctctataatttgttaccaagtttatttcttttctttcctttattagttccccttttgtattcctgggcttatttgatgtttttttaatatatatatattttaagtagactcttaactcattgatttttcagcttttcttccatactaatataagtatttaaactataaatatccttctattcttggtcttagctgcaacccacaagttttggtatgtaactaatgtatgtattatcaatatgtttgaaatttcattttatatattctttgacttacgagttatttaaaatattatttatttattaacatgggaatgttcttgtttttttatttttaattgtggtactctttcaacaaatttttaagtgttcaatgcaaaattgttaactataggtagatgttgtacagcagatctctagaactaacttatcttgtgtaaatgaaaggttatacctatttaatagcaactccccattttcccctcttctcaggctcctagcaactaccattctactctctgcttctattaatttcactattttagataccttataaaagtggaattgtgtattatttgttctgtgcctggcttatttcacataacatagtgtcttcaaatttcatccatattgttatatattgcagattttccttccttttaaaagctgaataataatagtctgttgtatatatatatatgccacattttctttatccatccaggatatcctcgttttttgttttgttttgttttttactaggctttagtttaattgcattgcagtcagagaacctactctgtgtgtttttaattcttccaactttgttaagcatatgttccatttttgtaaggattccttgagtccatggaaatagtgtgaatcccataatttttaggttcagtgttctgtataaatcagtcatatttgctaataatgtcatattttatccttattaatattatcacttttttgagcagttcatgagaggtgtgttaaaatctcctgctttgattatggatttattgactcctactcataggctgtctatcatttttttcattatagattttaagtctatgttatttaaggcataatttttaaattattctatcttccttgaaattttgatcagttatgaagtttccttctttagtgatgtttttgtcttgaagtctactttttctgattttaatatggccacatcagctttctttgatttttacttacatgccatatttttttcctgtccttctatttttaccctttctattttcttatattttagatgtgttgcccataaacagcattgagtttggtaggctttgtttttaatctagtgtcataattattgtcttttaattagagtatttagtccatttacatttaatgttcttatgggtttttatctaccatcttactttctacatgtcctctatattcctgtgtttcatttatggtactatttatt

SEQ ID NO: 1636 - DNA, 11241 bp, Homo sapiens; identical to SEQ ID NO: 1186

SEQ ID NO: 1637 - DNA, 1931 bp, Homo sapiens; identical to SEQ ID NO: 1185

SEQ ID NO: 1638 - DNA, 2904 bp, Homo sapiens
tccatgtcctctgttaagaacaaatgaaaggcaatgacacatagtttctattagcctttggttacaaagattcatcatacaaaatcaaaaaacatgattgcctttctagccaaccttcagcccagagataataacttgctcaggcttgaagctacgttaaaatcattcaggactgtggccaagtctgcgctccgatcctagcaatatgttttgtaaactaaagtgattggccattcctcatttactcacccttaacatgtaaataaggaactaaaatttatcctggaaatcaaaatcaaatataaccacagcaaacacaggcacacaaggtgcttttgaagagactattctgtatatacaaatgtattacacagccacagcttggtcaggaaaatcaccacttttcctaaagtcagtaacttcctctctaatttccttaaaacatttttttccttagtaatcaaaatctcaggtaaaaagcccaggaataatagaaaaaaattactattatattgaagaaaattactaatagtattaattcctattactattgacctcagtgaaacacagaatgagagttctagtctcagaagaaactgtaagatcctgtacttcaactccagcatttggtaagtgagaaaaccaaaaggtcacgtgattaattcaaatacacatttaagaaactactgagtcaatgccagagctcacattcattgcttcacaatcacagtctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcagtgtgagactcccatgatttaatgcaagcaaacctggaattaagttattaatgaatataggaatattaatgaatataggttggttgaagccatgtccttgtaggtgatactcccatgccaatctccttatttgtagagagtgctctctctctctctttctctccctctctccttttttttctttttctttttgtaagaggtggggtcttgctatgttgcataggctggcctcaaactcccgggcccagaagatcctcccacatcagcctcccaagtagctggaactacaggtgtgtaccactgcacccagcttgtttttgaatagttccaacattatagacgaagaaaaatgagactaagaaaactggagtaggctggggtgtggtagcttacctctgtaatgccagcacttcgggaggttgaggtaagcagatcatttgaggtcaggagttcaagaccagcctggccaacatggtgaaaccccgtctctactaaaaatgcaaaaattagctgggtgtggtggcagatgcctgtatttccagctactcgggaggctgaggtgggaggatgacttgaaccagggaggtggatgttgcagtgagcagagattacaccccacactccagcttgggtgacacagtgaaatggatctcaacccccccttcaaaaaaaagtccaagaaaacaccccccaaagaaaattggagtagaaaggtggttgtagatagtaagataatatgaatagcaataaattaatattatgtttatattaatactgaaatatgatttcttagagtactttgagttttaagtaaatgaactactagcttaagaatcaaagaaacaaatgaccatgagatactacttcacatccactataaaggctatagtttaaaaatggacatgacaaagtgtttatgaggatgtggaaaaactgcaactcacatacattgctggtggaaatgtaaaattatgcagaagctgtggaaaataggttggcagtgcctcaaaaggttaaacatacagttgccacacaatccaaaaattccacttttaggtatagttctaagattaatgaaaacatatgtccacacaaaaacttgtgcacaaatgttcatagtgacatcattcataatgtggaaacaacccaaacatctatcaagtgatgaatggataaatacagtgtgatagttctacagaatgcaactgtaataccattcaattataaaaaagaatgaaatactgatttatgtggcaacaaggatgaacctcatacacattatgttaagtgcaaggagccagatataaaaggccacatgtatgattccatttatatgaaatgtccagaataagcaaatccggagatagtaagtactgtagtgattatcaagggttggggaaggaggtgagagggataagggtggagtgactgttttgttggagggatgaaatgttctgggattagataccggtgatgtttgcaaaactttctgaatgtaccaaaaaccactaaagcatgcatacatttttaaaatgtaaattacgtggcattcaattgatatctcaatgaaaaaaaatcagataaaccaggtgattaaagaaagtgagggaaggaatgaaactattgcacattccttgcctggcagcacagggctatatgataacccatgtgaaggaaaactggctcttcgaaggccttgtctcaatattgccaggacagagtttagtcattgccaagtatatggataaaagtaactcagattcaatatagatgataatattaagttctgtttttttcctaggactaataaagtatttttaaaatgcttagatttaggtctgaattttaattcattttcttttaaaaacaaactaattaaaataatcccaaagctttttattattttttttt

SEQ ID NO: 1639 - DNA, 6623 bp, Homo sapiens
ccccagattagatcagtccactctcatgtatcacatctgaatgttttataaacaaacacaaaggcaacttaatgcaggagtctgaaagacatacaatatgtcccaaggaagaggtagagaagctgaggacactagttttgcagcactgtaaaaagaagtatcccaaaggattcagaatttcccaggctacagactgactccttggtttactgagacgtcttaaaacggctcttcaaagctgatctcctaattgtgattcttgcctagaatctgatctggtcctactcatttctcttatccagttctagggttttctgggaagacaggagagggaaaaatattgactttcctccaagtgatattaggaatgactaataaaaataatggtgagtcctggaaaattcagagagctgcattaaaaaattaatggcccgagttccttggagtcatctgaaaattaaacaatcacccagagacaaatccaaatttttttaaaaaagcatttcataaagacacagtttattctaggaattttcagtaactgttattgcttttttgtggtagctatgcttcaagtaaggctcatttcgtttcaagcctaacttagttccattgcagacaaggaaaggggacggggaggttatattttcatattatctgattttgtgaaattgctatgtaaaaatgtaatccatttcatgaagataaaaaactactttaaaacatttttaaataaaataaaacgtaaccagtgaaatatggctgcatgattacggggcacagttgaacctaattaccagcaaattacaaaccactccactaaatgaatataaatcctcaacaatggagaagggggctctatgactatatgatatgcttggtactcttttaaatgatacttccctatttgagtaaaacaaagaagaaactgcaaagggatgaggcaggataactgcggctcatttgtcacaaggctccaacttgcttgatttttccctgtgtgtcagagaatgtgcacattgaaagagagggagctctccatcaccaagagagcccaaaaatagcccaactgatcatagccattgtaaaaatattcatggatgtaaggaaagatcctttcccagtctgatgctccttgacttgtgatttgctaaatttgagaagccatcacttacacaacctgttttatagacaaatccttccagtttcagaagaaaaaatgtcatctatctcaacctccatctctttttcaaacttcgatagatgagaagaaaatggtgaataaatttttagaatcagttttgcaagattggtttcaaggaaggaagagaacaggtgaagtggatagagccacacttcccacataactaagggcaagttagttttatcacttttgggtaaagtgttccctatgaggggatttactcctttcataagaaaatcaatctcttcttccaacaaaagctactgaaccacttatgctgttacataaatgtgttaatggggaaatccattcaaacatctgcactaagcactctgtatttatacatatgaatgagattgagagacactgccattcctactgttttagcttccactatagtggaaaagggaaaatatatacaatatactctgatccaaggagaaagaagaaaacttcacaaaatacaaacttgttaaaaaataaagacaaaaagaccaagtttccctggggctgaagctgggttatgggcacagacaaacatagggcctctaagagagtcctgcatgctaggcaatatttagagttcttcctcaccagtagctcaggatgcattcagatgtaagctcgaggagtcacgcagcatctcttggcattattggttgtttgcacatccatgtctgtagctggactgcaaaccattctcaaggtggtaaatattcttccctggggctttgtgcatggtacaccctcagtaaatattaaatgaatggatgtatatctgacactgggcgtgtcaaggcttcggaaaatttacttccactcccataaaacttcttctttaaaaaatgcttgcaaaaataatagataggaggattcaatttgtgtttgcaaccttgagacagcaagctgaggaactggtttgtctgcttgctgcccgtgtccttcctgctcagtggactgattcaaggatttgagtcttcaggatgttaagtgagtgaattaaaaaaaaaaaaaagtagaactgaaaacagtgaaaaatgcctgtcatcagcatcgtaatgactgatcaccatcagccagataattatacaggctgaagatgatttttacaaacataaaacctaaaatagatgcctcaaggttaacacatcctaattatcttttgtataaacatcgtataaacactctatactctatttttaaaggtactgctaaagaaaaaataaaaagaaatagagttaataaagattatttgctatatccagagatatactgaaattccagaataaatcttcctattacattattacctatcaaggtagagcagagtaaaaattccaccaatacaagcatctttgtaaaataacatatttaatatgcacacttaccaaaatattacagtgagaaaatcagtgacaagtatttatgtatataaaatgtgtagagtaagccataccaaaaataaataacagagaaagtacttcaaaaattccatatttgcctactgtttatatacctcacaagaactatacctattaacacacttgagagaagatacatagtaataaaaataggaacgtggtcacactgatggctaatcagaaaaactatttggtgtaaaccagggtcgtcagagtttaagaatttggcaagaaagagaggaagagagaggagagagaagaggggaaagagagagagatagaatatagaagaaatggtttctacttacagctactatctaatcccctggcttttctgaagttgaagccaataatatgtgaatactttaaggatacgtaagcatttgtccaaattagcatgactgatgttcagataaggacataacaaggacacagtgtggcactaaagaaacaaagttgctaataacatacagcttttgcaagtaaactggtttccttcatatcaatcactgtggaaggcttcacattttctttatccaacgatgccatcagtacaaagtccatggtttaggtgtttctttaaattatgctttaagaacctaggacaggtccttcaactgttttcaaagggaaaaaaaatacatcctaacaaagtgaaaacagatctttcaaataatatagataatgaagctgcatattaatgttttagattaaagatgattagtatctattatttcttttgttcagtacctggcatgagagctatctataagtaatcagactttatttatagataaataaaatttataggaagccattcgtttagactgagctcctgcaccaagcccaacagaccaaaccaagatggagtcactcatgctgaaattcctcatcaccaagccaaaactaagttgtttatttgaccttttaagcaatcaggagagactcacatccccaaacagtccagttttaggtactacgataaggaagttcctcctgcattaacctttgcaagtaaagtaactttgaaaagaccaatttgctttttgttttctatatatgttttcctctacccttttctgtttgtaaaaccaaactctgttcagctcattgaaatattcattctattttatagaatgcaaaattgcttgactctagaatggtaaataaaaaacaattaggatcttcaaactaaaatctgttgtaattttgtctttagaattatatctacctgttgggactagaaaaggttttgtgaaggtggtgttttctaagtgggaactaaaaagattggtagaaacaatacaggaaaacacaatagaaaaataatgaagagagtttgcccaaggaatggtaagatatcctttttagttaagtaaagtataagtaagataaacaactagaaatgtactttggggacaaaatgtgaagaaatatgaatgtcaagccacggaatttggactttactcattgttctccaggaaattatgaaagattataaattacgagattggcttgaccacattgttcagataactccacattccaacctcccagctaaggatattgcctcactgtcacctcactgagatggattggaacccctttccctgtaatctgaaactaacataaattatattaccaacagcatcttgtatgtatcacaacactccatataaaaccaacacctactgataagggatggaataacgttacttacttttctagattatcaatgttaacagtcagcgattcattaagaatcatcaaaccttggagttaaagaggctcatatatgcagtgttcaaaaagcaaacgtggaaacaaatgctcactggcaggagagctgattcaccagtcgtacagtcactgcagaaaatatagtccacgtgtttaagcactaaagtttcttttccctcacaagagcacaacttcaagaggaaatgcatgggtaaaatggataaatcccaggcctacacaacaacctagatgaagtctagaaatttagtgctgagtaaaatggacaagtttgttcaagtcatcatccagcgcaaatcacaatgttctgaatgtgttctgacaaggttttagagtgtagattcactacttttttggttacagcttattttaaaatttatgatttcttataaactcacagataaccaaggtgccttatgagaaaatgattctcattttaatgttgttgttgcaagttagaaaacaatacccccaactgaaggcctcagaatccaatctttttctgtccttttcctgtcctcctgcctctcagttccaatttttcctgaggttagccatagaaactagaccccttctttcccaaggtgggtgatagaaaccagaaccccatttccctgaagccagccaaaaaccttaacatattactctaacttgccccctctacctttctgtacaaaaattggctatgaaaaaattatctgacctaccttgtttaactgtaggtaataagattccctttccagagagggtcctcaccacactcagaagaaaggaatacgtactcagaaaggccaagaaaaatctagacagacaggtcttactgagtttccctactcagtctattagcattaaatcatattcgttttgtccaatcatatttctacaggatactgtccatactttgttaaacctaagaataaaaagggacaaattattcccctgcttctttgggccttcattctgaaaggcttcatgtcatgtaaaactgtgatcaaacaaatttatatgcctttttcctctcaatctgcctcttgtcaataattttcagtgaaccttaaggcagcagaggaaaatttttctcttagcccgtatactctccattcattgataaaatgattcactgctgtccctatcaaagaatagattgtttctaagtgaagatattatctcaagtttattcagattttagagatatgcctaggccagaagagagaagccagaagttggtaagaggagccaaatttgaggagcagtcataaaacacttattacttttattgggctgaatgagaaagcattctgtaaagatttctgtccatatgcataactgctgtgattgcaaaaccaagagacacagtaaagacggttttcaagggaaaccaaagaatgatgcttggtctgcagtgggggcagctgtttgatcaatctctatagggtattcacatgaagtttttggtccacaagaggcaaatctcttactatttttaactgggtaactatgagtattgcttgcagaacctacaactgtgttgcagtgctcactactgcttgcatgggtctttacagtgaacattctttcctccttgcgtgtattcagagcacggaagtccaccgcccagcatctgtatgaggatctggctgtcacagtccctgcagctcctatcccgtacacatacatttccctgttttctttttttgagacagagtctcgctctgtcgccctggctggagtgcagtggtgcgatctcagcccactgcaaccttcacctcccgggttcaagcgattcttctgcctcagcctcccaagtagctgggaatacaggcgcctgccaccatgcccagctaatttttgtatttttagtagagacggggtttcgccatgttggccaggctagtcctgaactcctgacctcgtgatccacctgcctcagcctcccaaagtgctgggattacaggtgtgagacaccgcgcccagccacatttctcctttaaaggttttacgctgttaccaatcagtcagcttacctacgttaaagactgaaaatcatcactatgttaacatatattgatgaatagacattatgtatgtaacaggatttttttaaatgacaaactttgactaaggcatcagggaatagatatgaactctaaaattttattccagaaaatatagaaatctgaaaataggtaacacagaaattgattacactgctctaaattctacaaggaagacatagaaag

SEQ ID NO: 1640 - DNA, 1517 bp, Homo sapiens
tgaaaaatgtaagccagaatttcactttgctaagaatcgttaaattcaaaatatccttggtaggcattaggcctaaaatctcattgcattttagctctgtaaccctgggcaagtcttttgacctttttaagcaaatatcttgccctacctaacctctcatagaacatatatactgagcaattaccgttttccaaccaccaggttggtacttatcaccacaacccaagaagcaggtacaacagttatctccattttactgataagaaaagtgagtcttattaatgtgggttaagtaatttacttatagtcttacagctaataaatgataaagtaggattagaatccagcccctggcccaactccaaactatatactatatatcctcctactccataattagtagatagtatatactgtactatcttcctaccccataatagtcatttagggtttgaatgaaataacatgttaaaatattatgtaaaggtaaagaattatacaaatgtataatttttgttttataatatctaagattcttgatcattccctaagtataacttttcaaagagtctactgtattcattcttcatgtaaatattttgatcatctattaatcattttcagttttcttgtgactaagataaaattttcaaatactagactgtggaaaagcatacttgaagtagttaaaggtgaacaccggctgaaagaaaaatgaagtttagaaaattcttttaaaaactatcatagtatttaattggtcttcagaattggattactgtttcagtgtaactgttgacttgcataaactcaaaagaaacagtttctcatattccagtaagcatgaaacatactgttggtgttgtcctgatgttatgttatatattttaattcttactaaaagttttctctggttagaacctgctcagtccacttttctgcagaacagacatcactaaggcaaaataaatctccggttgtacatattgatcaaaatatggaagcctaaaagaggcatgctgtttgaaaaacactgtgaaacatcatgcagatgagtgttcttatccaaagccaaattcttcccttcttttagttcttctttttctggatacaggaaatatattcccttttgaagaggcaatatgcctgggcctccctccttctcctcaccagtgtctaaaaggaattattccacttccaaggccacaggagactatatcagtgccatctatgtttagagtctaacaccatcatcctttcagaaggcagcagtagcagctatctcaaaagacagagcagtaggatgggtccctgagcagatgcccacctgtccaaagtcccaggctccatctgagtcaggtgtcattgaaacatatcacccagtgaaagtcacatggagtcttaataatgcagatttagtcaacttctttatttcagatgtccaactaaaaacacctgggagaccttaagcattatctattttctctttcaccaaacaaaatgataaatggaaaaaa

SEQ ID NO: 1641 - DNA, 8882 bp, Homo sapiens
acaggtttattctgctgcattcaacatcaagtgagaaaaagttaccctgctttcaataaagtaatgtggcaatagcataggtgaattcaatatttaaggaacaaactgcatgccaagtcaattctttctaggtcgggtccaaacaatactatggagtgcctggtaaatgctggacactgtgcttcctgcctgcttgcactcaccactgtcttattttagactccacaaaaaccttggaagcaacaggatataacccaggtctcttcaactataaatctttatatgttctaccatatataataaattatctttgtgcctctttccagctgtaagcaggagtgaggggtgggagcagtttcagggatctcagtagagatcatatccaacacttagttgtggtttggcacaacctggtggcaagtttcctgctcccactctaatgtccataagagattctaggctcagtgattggctgaaacttctagacacctaacaagctggtaggtatctcaccagcttgacccaaggaggttgggcctgtagaactctggggactccaggacccaatttttttctccccacttactgaggaggggttgcgtgacatttcctgctcagccttatcttgccatccatgaactccccgagcccctcaacacccacaaccagcaaaacaacaacaataggtggaagactggggccaatagtcaattgtcttgaatggaggtggggaaggggataactgtatttatagcaatgtaatattatgtctaagagtttagcttcaccgatgaaaccccatgattacttatacttagtcgaatgtgtttacatacatttagttgaaatctagcaacatatctaagaactagtgaagaaagcatacagtagtagcagtaataatatatgaagagaaaatattgtattgaaaaaatttttcaaaagaaaataacttgacactggaaagtggggaatagtccataaaagaaaaaaatcattgttataatgattactaaacataaaaattaaccaagtgtacatgtgaaagccaccatacacaaactgaataaaaaggtatgagtctttgcttcttgtgcacttgtgatttttcaggggggtggggatataacccagatgagacaagcatgggtaacaagcaggtaaatcacatctcctaaaactgaagacctggaacaaatgaaatactgaagcagacagtatattaccctacactggatttctgctcatgagcttatgaaggctctggattcctgcttatgagctacctaatgaactctggaaatttacgcaagttaatttctctaaacctcaatttccatatctatatatgggccataataatatccatctcattggttgttaccaatgatttaatgaaagaatgtaaataaagaactcagtatagtacctgacaaatagtaaatgtagttatacaatcagctattgttattgatcttaatataattaaatcattccaaaatagtgcttggaaaattggtattagtgtctccagaaagagcttaattgcctctgacacagtctatgttgcaatataactttgcctgaactggatagcaaggaagaagccagcaaggaaggctctattttcctccagaagtgggtatcaaagactaaatttcatcctctcatttttgtagagaggctttagtaaatataaatgtaagtctaggtaacgccatagagatccatttgtttatgttggaaatgtgcatatgtcctgctgcagactagaccacactcatttttactctttaaaaaaatcattcaagtcttgttaaaattctttctattaaactgctgacaactgtacttcttgttagtgtggtttccatttgtacacatttccccctgtgtctctacattataaacctaataatgtattattttagaaagagtctaacatgataattcttacacttttttggaatcactgaccccggggggtctactcagaatatatatatataaaagctatagtttaaagcaatttatgaattgaattaaatctctaaggttaatgccagcaaggcatttgaagggaaagtgctgctcataactgctccatctagcatttctgttaatgaaaagacattaccttctggtagtaatggagccacttaatcctcaatgtagaacttggtaagagtggtactcaaaacggttaccagttagttctgcagggtcatcaatcagaatgaatgccttgtgatcaagcaagtttctagaggcccccacttattctaggagtggacccactttattgctgggctgtggagcgggcactcctggcagaggttgtggtggtagtaggagggtctttgaacagcagaatatggatatattgtaatattttaacaagcatgacagctaaatgtcagccttatgtttacatataataacaaagaaataaattcatgccgaaaatcaactcaagatactctcccaggttgggcatggtggttcatgtttgtaatcccagcactttgggaggctgaggcaggaggatcagtggagcccagaaatttgagaccagcctgggcaccatagtgagaccctatcactgtatttttaattttttaaaaatttgccagatgtggtggcacacagctgtagccctagctacttgaaaggctgaggcaggagaatcgcttgagttcaggacttcaaggttacagggagctatgactgcatcgctgtattccagctgggtgacacagggagaccctctttctcatcatatatacgtaatctctctcaaatctgaaaatgtgaggaaaaagaatttctaattctaaaactttgggcaccaccttcttaaaacatgggtgaaaaagacaaataatacttttatttttgccttcacttttggttacctaatttagttatttcatcactctatagactttctttgatcatctatgatttccttgtattttatagaagtttttaacaacaggggcatatttaagaatccaggccgggcgcagcagctcacgcctgtaatcgcagcactttaggaggccgaggtgggtgaataaccaggtcaggagaccgagaccatcctggctaacacggtgaaaccccgtctctactgaaaaaaaaatacaaaaaattagccgggtgtggtggcgggctcctgtagtcccagctactcgggaggctgaggcaggagaatggcgtgaacccgggaggcggagcttgcagtgagccgagatcgcgccactgcactccagcctgggcgacagagcaacaatccgtctcaaaaaaaaaaaaaaaaaagaaaaaaagaaaaaaaaaattcagcatctggataaaaaattaaataaaattaaaacagtaatgatgttaggaacaagaaagaaattcttttataaaacagtggcatattaaagaattcagcatctggataaaaaaattaaataaaattaaaacaataatagtaacgatgttaggaacaagaaagaagttattttataataatgctaatttttgtgttttagactttacagtgttattttacatatatcaactcttttaatccatgcaacatcctgggataccagggttattattcctactttatacatgaagatgttaaagctcagaaaattaactcaaattaactcaccaaggctatacagctagaaactgggagacagtatttatacccaggtcttcttatttgagttcactttccactacattaaagcacgctggaattcctgggatttttctttaggtgagaggtaaattagtaattataatgtttgttctagagagtaaaagaatgaaacatattatcatcttaccttattacctgttgtatgtatttgtgaccacttcttgagctccataacagaatactcaagtgctgagactaatagggatgtgtgtgacagaggtcgctagaaactgtatcagcatggtcaagaatttcacactttattagcttattttaagcttatttttaaggcgtggtggctcacgcctgtaatcccagcactttggcagtccgaggcaggtggatcacaaggtcaagagatggagaccatcctggccaacatagtgaaaccccatctctactaaaaacacaaaaaatagctgggtgtggtggtgcgcacctgcagtcccagctactcgggaggctgaggcaggagaatcacttgaacccaggaggcgaagtttgcaggaagccgagattgcaccactgccctccagcctggtgacagagtgagactccatctcaaaaaaaaaaaaaagtcctaaaattttttaaaaaaagaaaacaactgctactggattgtataacaccattttatacgagcaggttgtgctaaattgtcagaagatataaaattcttaaagacttgcaaatcacaatgttttggaatggaaaagaaagttagctaacaagaggaaaaacactgcctgctccatgagtaggtctcatcaaattctatcaacttatttctaggcttaaatctcatcagcaagtccaggatgtctgatatagaacacccattatgtaagtcacactgaaaccctataggattcatgggatggagggaggaaatggacagtcaaggaagagtggagtcaagaagtagatgaaatcccccaaactcactgaatgacactaatcgaagtaaggtcccctggcaatctcctttagtccctcactttacataaagagtgactgatgctcggaggacacaaatcactttcttaaggtcacacggtaggaggacttttcagagaaaatgacaatttttaggagaaagactatgcaagcaagtaatatattttatggaaaaagaagagggaagaatagtgattgttcagcacctgtgagagaaactcttatcttccttctctaccaagatggaggttggtattgtttttactactacacagatgagaaaaaaatgatcttgggagattttttttaattgctcaagggccactggactctgaagtggtagaatggggatcccaaccttggttcttctctctcaaagtcctttgctctttccaccctaccaccatatttaacctaaaactcaggcttcagatatcaaattcatgcattaatgagtgtaaaactagacaccatagtgattcattctagaaccagtatatgtatggaaccagggaaatatataaaatcagaacacagataaagagaaaaatttcaaaccatgaaaaaaatttgtaaagcctaaactgcattgcacattgtcatactttatagatagttaattcattcagaaaacatacatagttctcaggaaattaaattcctacatttcgaattcatttatccctatttttttgtgaacatatcagtagaactgcagataatcagaaaggtttatgaacacttgaaggtttttctttttagcaggaaaacaatatttttcagcagaacaaataaatgaaattatgtaggtaagtatttattctgaatcaaaaaccccatagaagtcaagtgctgcccaaaaattatcaacagaaattatttctacatccatctttaaaacgaatgacttccttttgcttcaaggccaaagatggaggtttggatcacaattactcatgttccactcctctctgtaccacacatctagcagataatcacatggaccttgccacattttcttgaattatggattttgtgaaatacagacttcttggccttagattttaaacctctcaaaagtggcaccatcaacttaagtttctgtcccaataaaacaaacaaaaaaacagctccagccacagtgatgacctgatagcttgctgttcttgacataaaccttgttctgctcccccttgctcacacagttctctgaatagttctctctctccctcttcctcccatgcatatcactttctaacaaaacaccaaactgtctgtctcctcaaggggccttgccttcctcagtccaatcaggtcacctctcttcattttctattcatatgctttgctatctcgtattggaaacaagtagtgtgagtctaagataaagtcagtgaagaaggcggtatctatggagaccaggcaaaacccagttccttcataggcacagtcggaccaaagcagcagtgttgctctaagaagtgtcttctatccgtcttctacttgagtgctcctggggattggaagtttctaattagcccttttgatgaccagttggagcactcttacatacattttttaaaaatagagactcaatttgtcatcatgagagaatctttcacttctggacatgctcggctcccagttttaatgccttaaaacagctgccagtgaaggaaaagagaagaaatgagaaaggtgcttattgtttttcctaaaggactaaaccagaaagtagctaagtggtggcactgaggaaaaagagacaggaaataagctggttgtggcttatttataatctggttccaatggagttcaggccaaggcccatcaagccctttacctcaacaaggccctacagtgggctcaggctgaagtcttctttctcatgcatcatttactcataaggcaaaaagatatttagtacccaacataagcaaggcattgtgccagacactgaggtgagtgacaggaaaggggatggtatagttggaaatgcttacgtggcaatagaaagtccaccatgtttagaattaaaggaactgtaattattttctgcacaagcccttcacgttatagatggagaatctgaagactttggggaaggatgggtggaagggtatgggtagagggaaagctgggactagattattcctaccacaaataaaattggaagctaagcattttttttctttttttgccacagtacataatctcagtggtttaaccagaaaaaaaaattataagaaaaactacttataagtgactactcttgctactctgttttgctacaggctgtgtaggcaatacaaataggttaggcagggggaaaaaaaaatctctattaggacaagtagccctgtatacctggatacttttacctagttcaaaattctagaattataattgctccccattcaactcgggcctgatagagtaaacagacattttgtctgaagttgttttatcagtattgtcttgttgatgaagattgcacacattttacaaagctctgttgggataaaccctcctttttgggagaagagattatgtcttcgttatttgcccctgtctttgctggtgtacactgtagcacatttcagactacctggttctaggtattggaatccaatcttatttgtctactgccaccagcatctctggccctttcacgggtcctggtaaagtggtatttgcaaactgtgtcctcctgatcctagtcacagatccttcttttctgctggttttttcccctcctatcgttgtttctttcttagggttatgggaaacttttagttgttcaccatgcgggatgcataggaatttgagaagcaacactcttgtccatcttcccaagctcctcgcccagttgttgctcctctaccatcataatatcatgcaggatgcaggatacttcacagggcatagttgtccttgcagaaaaaaacaaaacaaaaacaaaaccactttccagaattccctcaaatttctccaagggtctccatcttctctttatctccagagcttggtatcaagcaaagggaagaggggttgagcatttcatggagactcagtacacctcagctcgactcatagctcctctagtgctatttcctgcccattaggcacaaaattgtctgctttgatgtcacacgtttctgactgactatgataaatacatacagaagctgataattcctcacctgcctgccattacaataatggtctgagccaccatcatcctccacctgtactactgtgattgcctcctcactggtccatctgcttcctcttttgattctctagaacctatattcagaacagcagccatgtgatccctttaaaatgcaagtaacatagcatcattcttctgttccgcaaaatccttcattggtttccccttcattcttaataaaatccaaagctctgatattgacccaggaagccctatattatctgcccttcctgcctcctctctaacactctgctcttttgcctcaggcctctgcacaagctgtccccattgcttagactccagatatctttttcctgactgccttcaggtctggtcaactgccatgcacctgcgtgaccctcttccctcatgatcatacgtagaatagcaaccctatgccctctgtgaccctcttctccttctctctgcctcttcttccccacagcacttattatcacctgacatactatttgtttatttgctgatatatgctcatttccacccattggaacataaactccatgagaacacattattttgtttgctactgaatacccagtgcctggcactttacagatactcaataaatgtttgtaggatgagtgaatgaatgaatgaacaaactctaaattgggagttcaccaaactttgaatctttattagcaaagtcaatctttggaactaaacaaacaaacgaaccgaaaaacaatctcacaagaagcctgcattgggtttcaaaattattttttctgcggtgcacttttaaaagttcatttttcaattcaaagctaggcattgatttctttgttctgggttgcttctgccctccctctgaggcttgaaagatactggctcaaacggtagaaggctctggaacaaaggaaaaaccaggaaaaaaaattcctctttttataaaaatcctcaaattgcattactctgcctgagaatattgtaataaggatttaa

SEQ ID NO: 1642 - DNA, 9536 bp, Homo sapiens
aaaagacattaccttctggtagtaatggagccacttaatcctcaatgtagaacttggtaagagtggtactcaaaacggttaccagttagttctgcagggtcatcaatcagaatgaatgccttgtgatcaagcaagtttctagaggcccccacttattctaggagtggacccactttattgctgggctgtggagcgggcactcctggcagaggttgtggtggtagtaggagggtctttgaacagcagaatatggatatattgtaatattttaacaagcatgacagctaaatgtcagccttatgtttacatataataacaaagaaataaattcatgccgaaaatcaactcaagatactctcccaggttgggcatggtggttcatgtttgtaatcccagcactttgggaggctgaggcaggaggatcagtggagcccagaaatttgagaccagcctgggcaccatagtgagaccctatcactgtatttttaattttttaaaaatttgccagatgtggtggcacacagctgtagccctagctacttgaaaggctgaggcaggagaatcgcttgagttcaggacttcaaggttacagggagctatgactgcatcgctgtattccagctgggtgacacagggagaccctctttctcatcatatatacgtaatctctctcaaatctgaaaatgtgaggaaaaagaatttctaattctaaaactttgggcaccaccttcttaaaacatgggtgaaaaagacaaataatacttttatttttgccttcacttttggttacctaatttagttatttcatcactctatagactttctttgatcatctatgatttccttgtattttatagaagtttttaacaacaggggcatatttaagaatccaggccgggcgcagcagctcacgcctgtaatcgcagcactttaggaggccgaggtgggtgaataaccaggtcaggagaccgagaccatcctggctaacacggtgaaaccccgtctctactgaaaaaaaaatacaaaaaattagccgggtgtggtggcgggctcctgtagtcccagctactcgggaggctgaggcaggagaatggcgtgaacccgggaggcggagcttgcagtgagccgagatcgcgccactgcactccagcctgggcgacagagcaacaatccgtctcaaaaaaaaaaaaaaaaaagaaaaaaagaaaaaaaaaattcagcatctggataaaaaattaaataaaattaaaacagtaatgatgttaggaacaagaaagaaattcttttataaaacagtggcatattaaagaattcagcatctggataaaaaaattaaataaaattaaaacaataatagtaacgatgttaggaacaagaaagaagttattttataataatgctaatttttgtgttttagactttacagtgttattttacatatatcaactcttttaatccatgcaacatcctgggataccagggttattattcctactttatacatgaagatgttaaagctcagaaaattaactcaaattaactcaccaaggctatacagctagaaactgggagacagtatttatacccaggtcttcttatttgagttcactttccactacattaaagcacgctggaattcctgggatttttctttaggtgagaggtaaattagtaattataatgtttgttctagagagtaaaagaatgaaacatattatcatcttaccttattacctgttgtatgtatttgtgaccacttcttgagctccataacagaatactcaagtgctgagactaatagggatgtgtgtgacagaggtcgctagaaactgtatcagcatggtcaagaatttcacactttattagcttattttaagcttatttttaaggcgtggtggctcacgcctgtaatcccagcactttggcagtccgaggcaggtggatcacaaggtcaagagatggagaccatcctggccaacatagtgaaaccccatctctactaaaaacacaaaaaatagctgggtgtggtggtgcgcacctgcagtcccagctactcgggaggctgaggcaggagaatcacttgaacccaggaggcgaagtttgcaggaagccgagattgcaccactgccctccagcctggtgacagagtgagactccatctcaaaaaaaaaaaaaagtcctaaaattttttaaaaaaagaaaacaactgctactggattgtataacaccattttatacgagcaggttgtgctaaattgtcagaagatataaaattcttaaagacttgcaaatcacaatgttttggaatggaaaagaaagttagctaacaagaggaaaaacactgcctgctccatgagtaggtctcatcaaattctatcaacttatttctaggcttaaatctcatcagcaagtccaggatgtctgatatagaacacccattatgtaagtcacactgaaaccctataggattcatgggatggagggaggaaatggacagtcaaggaagagtggagtcaagaagtagatgaaatcccccaaactcactgaatgacactaatcgaagtaaggtcccctggcaatctcctttagtccctcactttacataaagagtgactgatgctcggaggacacaaatcactttcttaaggtcacacggtaggaggacttttcagagaaaatgacaatttttaggagaaagactatgcaagcaagtaatatattttatggaaaaagaagagggaagaatagtgattgttcagcacctgtgagagaaactcttatcttccttctctaccaagatggaggttggtattgtttttactactacacagatgagaaaaaaatgatcttgggagattttttttaattgctcaagggccactggactctgaagtggtagaatggggatcccaaccttggttcttctctctcaaagtcctttgctctttccaccctaccaccatatttaacctaaaactcaggcttcagatatcaaattcatgcattaatgagtgtaaaactagacaccatagtgattcattctagaaccagtatatgtatggaaccagggaaatatataaaatcagaacacagataaagagaaaaatttcaaaccatgaaaaaaatttgtaaagcctaaactgcattgcacattgtcatactttatagatagttaattcattcagaaaacatacatagttctcaggaaattaaattcctacatttcgaattcatttatccctatttttttgtgaacatatcagtagaactgcagataatcagaaaggtttatgaacacttgaaggtttttctttttagcaggaaaacaatatttttcagcagaacaaataaatgaaattatgtaggtaagtatttattctgaatcaaaaaccccatagaagtcaagtgctgcccaaaaattatcaacagaaattatttctacatccatctttaaaacgaatgacttccttttgcttcaaggccaaagatggaggtttggatcacaattactcatgttccactcctctctgtaccacacatctagcagataatcacatggaccttgccacattttcttgaattatggattttgtgaaatacagacttcttggccttagattttaaacctctcaaaagtggcaccatcaacttaagtttctgtcccaataaaacaaacaaaaaaacagctccagccacagtgatgacctgatagcttgctgttcttgacataaaccttgttctgctcccccttgctcacacagttctctgaatagttctctctctccctcttcctcccatgcatatcactttctaacaaaacaccaaactgtctgtctcctcaaggggccttgccttcctcagtccaatcaggtcacctctcttcattttctattcatatgctttgctatctcgtattggaaacaagtagtgtgagtctaagataaagtcagtgaagaaggcggtatctatggagaccaggcaaaacccagttccttcataggcacagtcggaccaaagcagcagtgttgctctaagaagtgtcttctatccgtcttctacttgagtgctcctggggattggaagtttctaattagcccttttgatgaccagttggagcactcttacatacattttttaaaaatagagactcaatttgtcatcatgagagaatctttcacttctggacatgctcggctcccagttttaatgccttaaaacagctgccagtgaaggaaaagagaagaaatgagaaaggtgcttattgtttttcctaaaggactaaaccagaaagtagctaagtggtggcactgaggaaaaagagacaggaaataagctggttgtggcttatttataatctggttccaatggagttcaggccaaggcccatcaagccctttacctcaacaaggccctacagtgggctcaggctgaagtcttctttctcatgcatcatttactcataaggcaaaaagatatttagtacccaacataagcaaggcattgtgccagacactgaggtgagtgacaggaaaggggatggtatagttggaaatgcttacgtggcaatagaaagtccaccatgtttagaattaaaggaactgtaattattttctgcacaagcccttcacgttatagatggagaatctgaagactttggggaaggatgggtggaagggtatgggtagagggaaagctgggactagattattcctaccacaaataaaattggaagctaagcattttttttctttttttgccacagtacataatctcagtggtttaaccagaaaaaaaaattataagaaaaactacttataagtgactactcttgctactctgttttgctacaggctgtgtaggcaatacaaataggttaggcagggggaaaaaaaaatctctattaggacaagtagccctgtatacctggatacttttacctagttcaaaattctagaattataattgctccccattcaactcgggcctgatagagtaaacagacattttgtctgaagttgttttatcagtattgtcttgttgatgaagattgcacacattttacaaagctctgttgggataaaccctcctttttgggagaagagattatgtcttcgttatttgcccctgtctttgctggtgtacactgtagcacatttcagactacctggttctaggtattggaatccaatcttatttgtctactgccaccagcatctctggccctttcacgggtcctggtaaagtggtatttgcaaactgtgtcctcctgatcctagtcacagatccttcttttctgctggttttttcccctcctatcgttgtttctttcttagggttatgggaaacttttagttgttcaccatgcgggatgcataggaatttgagaagcaacactcttgtccatcttcccaagctcctcgcccagttgttgctcctctaccatcataatatcatgcaggatgcaggatacttcacagggcatagttgtccttgcagaaaaaaacaaaacaaaaacaaaaccactttccagaattccctcaaatttctccaagggtctccatcttctctttatctccagagcttggtatcaagcaaagggaagaggggttgagcatttcatggagactcagtacacctcagctcgactcatagctcctctagtgctatttcctgcccattaggcacaaaattgtctgctttgatgtcacacgtttctgactgactatgataaatacatacagaagctgataattcctcacctgcctgccattacaataatggtctgagccaccatcatcctccacctgtactactgtgattgcctcctcactggtccatctgcttcctcttttgattctctagaacctatattcagaacagcagccatgtgatccctttaaaatgcaagtaacatagcatcattcttctgttccgcaaaatccttcattggtttccccttcattcttaataaaatccaaagctctgatattgacccaggaagccctatattatctgcccttcctgcctcctctctaacactctgctcttttgcctcaggcctctgcacaagctgtccccattgcttagactccagatatctttttcctgactgccttcaggtctggtcaactgccatgcacctgcgtgaccctcttccctcatgatcatacgtagaatagcaaccctatgccctctgtgaccctcttctccttctctctgcctcttcttccccacagcacttattatcacctgacatactatttgtttatttgctgatatatgctcatttccacccattggaacataaactccatgagaacacattattttgtttgctactgaatacccagtgcctggcactttacagatactcaataaatgtttgtaggatgagtgaatgaatgaatgaacaaactctaaattgggagttcaccaaactttgaatctttattagcaaagtcaatctttggaactaaacaaacaaacgaaccgaaaaacaatctcacaagaagcctgcattgggtttcaaaattattttttctgcggtgcacttttaaaagttcatttttcaattcaaagctaggcattgatttctttgttctgggttgcttctgccctccctctgaggcttgaaagatactggctcaaacggtagaaggctctggaacaaaggaaaaaccaggaaaaaaaattcctctttttataaaaatcctcaaattgcattactctgcctgagaatattgtaataaggatttaaatggttttggtcttactttgtctagacactttcattcttagtcttgccttgaattgcttaaatattaagagggtaagcagcttgtcggttagagtaaagttatgcaaaaagagcaaatctgctaaaattttccaaagaacgtagtggagctggggcttgaaatgtctggtaaggacatttgaacaggagactgcctattttcaaaagttggataacaggctttgatagtgaaacacggggtgcataactggacacaatggataaaatgaatagaatgagtgtcatcacatgatgaatgggctagttttagagtccacacattcactcaataatggttttacctggtttgcaaggtggcaatccacagttgccagtcctcaagcacactttatttagcctatatttgttaaagaaaaaatttcacatataaatcttgatctccattttcctttaaaagtagaaggtctgccacacttgcttgttaagaaaaaatcacccaggccttggaaataagacaaaaatgagacaaagggactacagcatgctcattcagtcataatagaatattgtctaaaaaatctgctgctatggtttggatatgtcccccaagtttcatgtgttggaaacgtaatccccaaattcatacgttgatggcttttggagatgaggcctttgtgagataattaggatcagataaggtctgatcctaaacagagttgggcccccatgatgggattggtggttttataagaagagcaagagagtcctgagctgacatgctctcgtcctttcaccatgtgatattttctgccatgttatgatgccgtaagaaggttctcaccagacgcaacccctcagtcttagacttcccagtctccagaactgtaagaaataaatttgtttataaattgccgaatctgtgatattctgttacagcaatagaaaatggactaagatacctgcctaagactcatacaattgtctaggccctagactctagtgatgcaatattgttacatttactgtgtactactgattagagttaaaagtctataaagttagatgccaacttgtagaagattgagtgattgtaaattatttttgtacaatagaataaataactccataggtaacagttttgtttccttgtagggtattaaccaattttttaactaactttattttctctcagtattcttatttctgttgactgtataaatattccagcctctcattttctcctttgaaccagctgtcatcttactaaattcttattatgagttaaattaatctttgacacgttcactgtatatttgtaagacagtcatgctttctttcagcttttggaaaattatatttggacctgcttcacattcctaaatgggaaccaatgtctagaataatcactagctgctcccattaagcaagggcagctctccaattcaacacagtttcctcctcccactcctgataatcttatttccagtcctttccctcattcatgtgtccttcttggcctcggtgagcctttgagttcttaacgtctgacttataccttgaggttttagtagagcagtggttcttactcttgaacatgtatgaaaatctccaggagggcttattaaaacacagattgctgggctacaccccagagtatctgactcagtaggcctggggtgagactcaagaattcgcatttctaacaatttctcagatgatgctgatgttgctagtgcagggaccacacttggaaaatcattgttgtagtaagtggtaggctttgaacttggtcttggtagattagaaggcatttttcactgtaacaatttgacaagttgaatgcaagacatagtaaagtaagacttatttttaaaaaactttgaaagccaagcacagtggctcacacctataatcccagtactttgggaggctgaggtgggtggattacttgagctaaagttcaagaccagcctgaccaacatggtgaaaccctgtttctaccaaaaatataaaaattagctaggtatggtggtgcacgcctgtagtcccagctacttgggaggctgaggtgggaggatggcttgagccagggaggcgggggttgcagttagccgatattgtaccactgtactccagcctggtgacacagccagaccctgactcaaaaatataatataatataatataatataatataatataatataatataatatactcttaaaatgtgaattacaacatattagataatagcatttctcatgatgcctactctacttgagaattaactgctgatgatattgaaaacaatgagtaatttttgtaaatttattgaaacgtcaagactgttcaatgactactttttttgtttgtctacattttaacttctttgaaggcaaagaaatcctagtagcctcctcagtgcagtgtctaacgtaggctaatgctatggacctggcaaacacctattgacttacaatgatacatttctatgtatgactgtggtttcctaagcttttcatattcattatctcattcaacatatacaacaatcctgtgaggtgaatagggtatgtgtattactctactttacagataaataagctaagttttagaggcttgacatgtctttccctaggatacaaagcaaatatatggcaaagccagggctagcacttgatctttagtcttgctcaccaggattatttactgacacacaatgaaaactagattaaaaatgccatgaggatttaggataagctaaaagattcttaaaatg

SEQ ID NO: 1643 - DNA, 108287 bp, Homo sapiens
tggcttgaaaattaaatgaaacaccaaaatgtgcttgatttacttataggaccctaggaaaaacacttattttcaaaagggtaccttcaatcctgagagaggatatttggcttaaaatgagaatgactactattatttaccatgtgctgagaaataagtgagaactgagtaaaagccaaagaaaaataaatacattggagattaactttactattatgaaataatggaatatttatagaattagtctgataagaccctcacctagggaggtataaagtagtagaaagaggacaaaagcaggagttcagaggacatgaattaaaactctccaggcctctggtgtaattgggagtaactctcatcagtaacatgggaataaaaaagctgccccatctagctgtactagcccggggtgagacttggatgagaaaaactacatgagaaatatacaatttgttatgaaatgaaatatacaatttgttataactaagttaaaatatagcctacttcagggagtgttcctgcatacttaccagaagaagagcatcactggaatggagttcattgtgggtcatcttcatttccccccactgcagctagctctccaagcatcatgttacaacttggcatccccaatgctcagtataatacatgggatacagcaaatgctccatatatatttcctgaatgattaaccaaaacaatgtcactataaggtgttcctaaggtgactgaagaacatttgttacaagccagtgttacagaaagactcaggcatacttttttgtatttggtatcactacagatgttttgactgttttaataaattaacaacatttcagggacctttaagaagaggaaaagaaatatttaagggctaataaagtttgaaaataacccataaagttactctaaaggatttcctaccttcctctactttcagaatcttattattattttttaactttagccatcaccttattcctcctaaaaatgacctatatcagacttttttaattcaactttttgttttagtaagaatttatatttacctaaaagttgcaaagagagtacacaggtttttgtacattcttcaatgtgctttatgtttccctatgttaaaatctcacataacccacttattttttaaaaactaaaatagaaggcaatttgagcaactcttttgtggaattgtctgagagaattatgcaatatccattggaatggaatagaatattttagttacaatacccaagtcatgaatcactggagtcaatcatgatcagttacaggcatgtagaaatacctgaatgtagaatttgggcttcatagaaaaataacgtttaagtctgagaataacctctgtggatatgttgctttacttgaagcaattcttgtaataatgaacacaaaatatatgactctctgaaaaatgctgaaagaaaagactgagtaattttattcaatgtacattagaaaagatccgaagtgattctgtatactacatacaattgactaaagaagatgtcataattaaaatgaaaaaaattgaaataaacctgcttattgatagaaaaccatatatgttcacacataaattataattataaaaaatgtaaattatatataattatatataaatacatataattataaaaattataaaaatgttaattataaaagtattcattttatttcagctgcatatatgtagatctgtacttatggtagaattatttccttgaaatatagttgtttggatttactatgaacttaatttttaaatattatttgaggttctttatgaagagtagcatactttatctagtaaagacaagaaattatccaagcaaaaattagcacttataaatttttatagtatataaatatagtagaatatatgatatatgaaataaatgaatatggctacacagaaacaggtttctgctaattttttaaccactgaatatactccatataaactcccttcactacattcttgctatattatgcaatgtatataatatctgtggttctaataatcaaatattttaagttagactgcttctgaagttaagacatataatttaataaaggagatctggtgaacatattcaaattacaaaacacttttcccttccttctgctacatttaaaaatattaggataccaagtgattcactcaatgaactgtggttttcaagtggatgttaagtgtgcattacaggcctgacaatgacatcagtggagttccataccaagatatccatctactactcaagggagagaggctgcttgccctagattcactgtatgttcttgatcgagtcacctcacattcttgaacctcggtcaacccatttggagaattaggtgaaagctaagccttagtgagaaacagatgctacatctgagatgagttttcttgtgtaaacaagtaattccaaagtttaattccaaagaaagttgctatgtggatggccatgatacatgacctatatgaaatagacaactgggttaaagctttagaataaatgtttcttaatacaaattatagcatcatattacatctgggtttcttaaaatatttttatctaatttttatttcttccaccttgtttattagatatatactatagtgatttttatttgaaatttatttaatgcttttggagcttattattatttttatctggtaacttatacttctaacaggtcaattaagttgtcaaggtagggggaaatagaacttaaaataggccacttattatctagtgcaagtcagtaaaagttaattcttcttttgggataaaagttaacaatcaacggatttaaagacatgtggttttaaaaacaacagctaagtttgcattttggtttaattcccagtagattacttgtcattttagtaaggtcttacattggaaaacacattgctactaaagatgcagataatttaataagttgaaaagaattcctcaaaggaaagaagagccctcttgagaaatgctagttcaagttgtctgactgctttctctcctctacaactatttgtctgattgaaatagctagaaacatcaaagtaagagctgtggttcctgaaattctccgagcttgccgtagctctaaacttatatttcctgtgttgactccatgtcttgctatcaacggtgcacatttcaaagcttcaggtttaacgtactgtgctttccattacacaactttttgtattttaaactgggaataagtaacatgtgaatcagcaagctattggataatgttgacaattctgtgttagctagtttgtgattctctggtttgttttttggtgttcccgcatttgacattagctaaaggagccgtagcttggcctttgagtggaaaacaatccaggaatttcagagaagaactaagcaacaaaaggcctagagctattatcttctgaagagagatgaaagcactcctgtccttgtgctttcctcggttgcctgcacagagccttttgactttagtgtgaaaagaacataatctgtgctacaatttggccctaggtttctttagaaactaagcgaagtcgaattgagtgagatgcaaaataaccgttggctaaggtacgatcatccttgggagaccaaaaatgtgatgggtatagatctaaaaacttgttggggaggtggtggtggatgatgaaagtctaagtttagacagtatcgagagaaaatatccaatcaaaaaatttactgaccatcttgggaagcaggctggatgaaagcagaaaatggttcatcattttgacattttgaaagtagacttgcatcataaagaatcttatactagtttcatttggagcagttgaattgtaaatatttttccctctaaaattctcatgtgaatggtgtgaactctagaagaaaaaaaaaacaattattcatatagtatgttcttcatatgtaatgtgtatatattcttcatatatatattcaattattcatatatatgtgtttatacataatatgtatatatgataccctcaaatgtacacataatatctctccaggctcttgccaaagaatattattttgaagtgtacaaaagaggagaagcttttcatcccatgaaaggcctgttttcttctagtgcactctgaatcacttacttactttggacctctgacctccttacgattccctggatctggaagtgagattgatgaacacaaagtgggacatacatgtgggagctcttatgaattggagctatattaaaataattagtctaagttttatctggcatagagttcagattctaccattactctgtgatgtaagcatatttaaagaataagggagttataatcgcaaggaaagttgggaagaatgaattcataagttagtctgtggtcctgaaagcttacaataggggaatcaatagtattaaatgtccttttttcttttttttctttttttttgagatggagtcttactctgtcgccaagtctggagtgcagtggcacaatcttggctcactgcaacctccgcttcccaggttcaaacaattctcctgcctcagcatacatagtagctgggattacaggcttgcaccaccatgcccagctaatttttgtatttttagtagagacagggtttcgccacgttagccaggctggtctcaaactcctgacctcaggtgatcctccctcctcagtctcccaaagtgcttggataacaggtgtgagccactagacctggcaaaatatccctttttcaacttcagtgaataaaattgctcttctgaagccaccttcaatggaattaatttttatacttgaataagatgaaacttgaaaggcccaaaagttttgcagagtagatgattcacgacggttgttcatgaaaagtttacagaaaaaaacctttagatgtttgttcagctctctcttattttaagagagactgcaaacaagaaaataaaacaaaacaataaaactccaaataaaataaaagaaaacaggaacttaagtttctactgcaattcttggcagaaggttaaggtagttttatataagattctgaaacatggctttttagttatgtatctatttttgaggaaaacgtttttctgcctatagacatcactgaagtcaacatttggtatatatattatttatgctctgatgttctgagtatatataacagtgagtgtgtaaagtagaataaattttaatttgataaaatgccaatcacaaaagggttttttttttacatcaaggagcttaatctgttaaatatgactggaaaattatttttcattttcttgtggtgtaaatatctaaataactgcatttctaagtgttaatatttttacccatggattttgttctatttagagacttttctttgaagaactcaaagctctttgattagcatctcatccaacaatttttaagtcagcgaatttcaagaaaaacatatgggggataggcaaagagacttctttaagaaaaatgtaatctcataaaaccaacaacttattcccatttttcttcttccccaacattaacagtgatcacctctatgcgccttggaattaagacatggggaaagtgtttctgttaataactgctctacctctgcattgaattgagatagattcttaagtttccattctgtggttcaagaaatactttgtgtgccttagaagggagttaggaatatgaggtgattgttggtttaactagtatgatttcataatgccatctgtttctcttctattttttttactcaaaaatttttttcaggacatcaaataattatgaaaagcattaatggatgttccacatcactgtgcctactcactaatcctgagcatgccctgctctttccttctttatctttttttttgtaaagtacattagttgtgtttgcatgtacagaatctaaccacttctcttttgggaacaaatctctgattttcatttgaggagtcaccattcttccattctcagcccatgtggtttagatggggttactttttccacttggatctatgggttgctatatgcctgaggctctttcattggaacatttcatttctctgactgcagtgagatccatctcaggttaacagtacttgattctgggacttctgatggaggcaatgatttacaaaaagttattttcatcagactgataagttttggtaagatgttattacaaggggggaaaattacctaaaaaggggggcaaaccagaggaaagcagagctgcaatatgtagagggacaactgctgataatatcatttgagtaccttcatccaactaggtaatctgacacatctgaagataaccagtcctggactttttattataaatacttgcctttcaacttttatttatttagcttaatttagtttgaattgagtttctgtcatttgggtcaaaggaattcttctattcacattacattcccaaagcactagtgtttagtatcataaaaacaaaatagcaatatgatgcttatgagacttatctgtgaactaattaaaaactttctgcaatctctaatgtgtagatactgaagaatgtcatcttcataatcaattttcactatcattttattttgaatttaaaatataaactgtcatagaattatagaattttcaagctaattttcaagttcatttcctccaattccttcatattatttgacagtgcagtacaacttagaaagcgttagggtataatgagaggctgtacagcagactaggaagagcacaaatctacacacccacattgttgtttggtagatgagtaatttagaacacattacttaagcactctgagtggcagtttacttaactattgttctgaagatatctggctcacaattgtcactaaatgtggtaattttaattttactattattgtcaaggaacatagctagttaataacattcttgctttgaacacaaggcataaaccaatgtcagtgtggcctttcttgctcttctgctactttaaattagaaaggggagtaacatatgtgtatttgaatctatttatttatttttttaaaaaattgcaggataaaccaaatctaaaataatagttatctgttggggtgagagaaaatagtgtggaaaggacagggatataagctatgtgtgtctgaatatataatgttttatagattaccttacattattatgaaatgaaaattaatccttgaaggcataatgagattcgtgagctttgtatcaatcaggtgcataaccacacaaagtggaaccactcatgtatcttcaaaacacataatttgaccgcacatatctagtggagtacatgaacaaaatgatttgcaagatactcttaaaatcttttcagtaatcatgttgctttgtttgtagaagctatctttcactacaaactgtttagtaacaaacacaaacataaataaatagttttccaactttattggggtataatttgcaagtaaaattgtatatccttaaggtatacaatttgattatttgaaatacgtatacatgtgaagtgattaccacaatcaaatcagttaacactgttaaaagaccaacaggttttatgcctgctgcaccataacagactaatacagcaagacagcagggtttgttagagagaaatagtttaattgcagggcttcaagtaaggagatggagagagcccctaaaatccatctcctggaggagttctgggctagggtttttaaggggatcattgagggtgagggaatgaaaaattgggttgttgattggttgggtaaggggaatgaaatcatcaggatgtggaaactgcattttttggtgagtcagctccttgaaggatccttcaaagctacctggcatcagcagttttgctgatacgcaaggcctcaaagaatatctcacatggaaaacttaagttgcacagctggactagactgctagctgggagcctcaaccatggagaacagctgactgtgctccttggcaagatgggatcaccaacttggctccacatatgagtggggcctcggattggctttctaatggggtaaggcccctggcatagatgtggtaccaccatcaagatacacatgctggtcgctgtgagccctgttccctttctttgtttctacctgacttcaggtagtgtattcctgcaaatttccccactgttttgtaggagaaaaaacaagagattctccttggtgtggtgctgtgcacccgggggagacctgatgtagttaaaatcaaactatttctcttactcttctaatgtggcttttcttggtttttgagctccaagcggggcacctccacctcaccctcaagttataaaattttcataaaggtgtttttgtatatgtatagttatttgccagtcagaatttttgtgaggggttctaaaggcagagaccttttagtcttccatcttgctgaatcactcttgataataaatatttacttagcttacaatcctgcagaatctagctgatatggtctggtcttgctaatgagtatgtagtcagttttaggttggctacatagatctgctcatcttggtgggctcaacctaggagttagttggctatcagctaatctagagttatttggctaagagacacagcagggccagtatggttgtatttttatatctttaatgtcttttggccccaggtagctccagcaaagtagcccaagcatgttcctgtggtaactgtagaagtggaaaagagcaagtagaaacaggcaagttttttttgttttgttttgttttgtttttttaaatcctcttcttgtttcatggttgctgaaatcctatgggccatggcaagccactgggcagagccagaataagaatgaaaaaacactacaagtttacaaagcaaggtgtgtagatgtgagtactggtgaaaaactggggcaatagataacagtaatctaccacagtatttttctaagatcgtcatgtacatggcatagaataaaacaaaggagttatgctaatgtttatgaaatctagagtttttgggatgggaaaaaggagatataatatcaaaaagattaagcaaaaaactattatcttgtatttgaattggatgtatcattataaacttgtaatgtattttagcttcaaaacaagtatgacacatagctctgtctactgaaaaagcctagacatcatgaccatcccagtggcaataagcacactagcatacataatctagtctctaaatttctcagtaaaataaaccatgaatctttgaaaaaaatgtctaacttcaggaaatgtaaaagttgagcctagaatatcttatcgcatcaccttgtcacatcaaacagcaagaaaattatcaacaatgtctgagataaattgtcaaaagaagacaatttgaggatatgtccctggtcaaagttggaaatttgagcatgaattaaaaaatgattgctgtggttttcaaatatcaaagatgcttaaatctataagctcatggtaataccaaatgatactcaaccctgaacttagtcatgccaggaaaccaattcattatttagaaaactggtggtaaataaaatgaagtaattaaaattttatcctgcctttaatatagaaactgctgcagggtaataaactagttattgagaaaatattctctccagaaaagtttcaagtaacagatgcagaataaattataaaattataataccagcattttctaatccttggtaaagtaatggctagaggatgtatatcaatggctgctaacttaataacaaagtgacaatcagaaattatgtgcctcctggtagaagtccacaacaatacttgtgatatcttcttgactaaaaaatcaagtaaaaaataaatgtaatcaagactttagacctaactaccacttagagaaaataaaaagaatagcaataaaatgaaacagcacctcaagaatgcaataatcaaaatctaccctgggaaatactacaagaccaggaaggttgtctctttaacaaatgcattgaagagaaatcgaaaagaagaggaaggagtaatttgtggattaaagagatacttaaactatatggatattattgagataaagatttaaacaatctgtcaaaaaatagagaaaagtcagagaaatctgaacacctattaacacctattaagtatatgatgatataaagggattattgttaattttttaagtgggataatggtgtcatggttacagtgcggtggctcatgcctgtaatcccaacattttgggagtctgaggagggtggattacttgaggtcaggagttcaagaccagcctagccaacatggtgaaaccccgtttttactaaaaatacaaaaattagccaggcgtggtggtgtgtgcctgtaatcctcgctactcaggaggctgaggcaggagaatcgcttgaacctgggaggcagaggttgcagtgagctgagatcttcccactgcactccagcctgggcaacagagtgagactccatctcaaataataataataataataataataataataataaccttatctgttagagatacatactgaattatacaggtatgatgctatggtttgaaactgtccccaaatttcatgtgtggaaaacttaattctcaaattaatatgttgattggagatggagatcttgggaacgtaattagattagataaggttatcacagtggagccccatgatgggactggtggctttattagaagaggaagagagagctgagctgacatacattcccttgtgctatttccctgcgatgccttttgccatgttatgcaggaagaaggccctcatggataccaccaccatgctcttgaacttcccaacctccagaatgataagaaatatatttctagttttttgcaaactacctagtctcaagtattctgttataacaacagaattgaactaagacatatggaataatatcatgtctaagaacttccttcaaaagaatccagagttgagagagtgaagcagggtgtggctgaagcatgattgagccatttcaacaattgttgaaattgggcattgaatatgtaggggttcattttactattttgcttgttcttgttatatgttttaacatttccttattaaacatttttgagaagctatttcaatataatttttatcatatatataggaaactgttgtagttaaaaaatagtctgctcatgattaggaacttgaggtcagcatcagactatttgaattctgtttacttactactgaagggaccttggacaaggtacataaattttcagcacctcaatttagttaggtgtaacatgagagtattaataggatgtacttcacagagttgttatgtgaattataagttaaaatatgtaacgtgatgattagcacagtgtaacacacgtagtgatcactcagtactttttattatgcttattgatgctatcacatatatgtccagctgaatacatagataaagggctgaaggatatatgtaaacttgtaatattggctaccgctgaggcaagaagtaggaatagagagagaagaaagagaagacattttgaaattctatatatttagtcatgataatgcaaatattattagagtgtgcgataattttaagactactaaatattctcaatataaaaacgattttctagaaaattacatttaaaatctttagttgggcaccttgtctgatacccagcactgtccaaggttgagcaatgaataaaacattgtgccaccacctccaaagagcctaaaatctaatagaggaataagaagagtactaaagataactagataaaagaatgtgatataggttctaaaacaatttataaacatagcaatgcaataatttagaatgtgacgctggaccaagttctaccttaaaaactaccaatttaagtgatttaagtttatgcagaaagcttatgttaaggtagagaaacatctagattataaaggagagagtatgagagataataggaaatcactttgtgagtgataggaccattgccaccaccttatcgttacagagattgccattatctgattattaatatgaattcatttgtgtaaaagtcagagtaatgtcaggttgttttggatctctctaagggatactacttgttaaacatgttctatgagaattgtctttgagaggatgccctggcataagccctaatagcagcactgagtaaggcttcaacatatttatattactacattttactgagaggaagggaagatttaaaagccaatgatagctgttggtgttatcacatttaattaaaaatgacaagggtctatttttactattaaacatttcattctgtggacctagtatagtgtatcaaattcttgcaagctgcgtacccagctgaggaggcagcatatcctcctggtttgctgttcctgcccagtggactctggaaaggctcattcatccctggaagcctgatccatatcttagaaagtggtgataatacctatctcattgaggttcacatgcggattacaggacgtaatgcatgtgaaaagttaagcctagtggaaagcacacatcagtgtttaataattgccagaaactgtgtttaattactggctctgcctgccttgaataggaggtccttggggacaaggacagtgtcacatgtactgccatgtccttggtacccaacttcatgaggatataaactgagtatttatttctatttactgtttttagaggtacttgtgttgcaagaagtcccccatggaggaattccatatgtaaaacctctactgtgggaagatttggccctgagaaccatgctgtttcctcctcagattggtgggttcagctgaaaagcataatcctgtcctcactggagacttttttgaaagggtttctgctgcatttatatgggggattgaaaataagggaaatcgaacatatgccaagggaccacattttcccttaagggtaataaatgtaaagtaagtaaaagaactgtgttaaatacatgcttgtctttctcataaaattcttggtcttttgtctgaggaatattcaaaaggtaatgtatcactgtgggcagatcagcctggcctttatttattttctcagcaactgtcttattttggataaaaggcaggagaaatataaaacgtcaggcactaacagggattttattatttattttctgagctctgttatggttgatgttgtttcattttttccattataaatccctttttctcaaggggctgtaactctcccaataaaaagaatggcttcaggcaaacacttgaagcatttgttctcagcttaagaggacttttgtttttccaggtcttgaaaataaaatccattacattctttttaaattacaggagtgttaaagtgaaaaagcccaggaattgctgcttttatatgtgcgctcttaccacctcggctcagaatttctttaagcagcaattctgcagctcctctcaccaccgattatatgagaagcctctctatctatcactattgatcatctgtactgagtccatcggcttcctcagagatgtttacaagtgctgtttgttggttagtttgtgccgggtcatttctttttgcctgatagatgtaatgcctcccagaagaaacaagtccattcagtacatggtcacctttcttcagtgaaacaattcagtggtctgctatccagagggcaatgaagtgatactggaccttgtcatcctgaaggtggagacatgctgataacttcaaaatatccctttctaatttactcccagaaaagtgctgagctgaatcctgggttataggctaaagaaaaattcaggctgaagatgagatcttacagacacatttcagaggctcgctataagtctgaggtctctgcatggcaggagttggagactctggtcaggccagagtagtcctaggtttccggatgtggctggggatgacatctatagcctagtaacatcaaaagtgcccatgtatctttaatattcttttcttccccctttgcttgctagctgagaccactgcatagtgaatattttaaaagcaagatttccaggagtttaacgcctctggaatacaaacacacacacacacacacacacacacacacacacacacacacgctatacattaagtttcctgtagctacttttgtccaaaaagatagcttaaaggagagaatattccatttagaatgtgctgctattatctagacagactatttttaagaatagattaggctgggtgctgtggctcactcctgtaatcccagcacttttggaggccgaggtgggcagatcacctgaagtcaggagttcaggactagcctggacaacatggtgaaaccctatctctactaaaaatacaaaaattatccaagtgtggtggcaggcacctgtaatcccagctgctctggaggctgaggcagaagaattgcttgaacctgggagacagaggttgcagtgagccgagactgtgccactgcaccccagcctgggcaacagagtgagaccccgtctcaaaaaaaaaatagataaatacaagaatagattagagacagaattataaagcaatgacaataaataattatgtgaagaatcagttgtttagaataaaagaaattagattcttatgtcacactatgcaaagaaaaacacagggggattttagaatcaaatataggagagggtctcagagaagacacaagacttttaaactataaaataaaatattggaaatttgactatatcaaagtaaaaatattctaaacaaccatggacctcataaagttaaaagataaacaatagttatttaaaattcatatggccagcacaatattacctaggatacataaagaatatctactaatcaacataaaacagtaggtaaaatagttgaaaatatatgtaaagcatataatatgccattcgtaggagaagagcaaccaataaagttaagaaatatgctacttcacaaataatcaggaactataaatagaaacaaaggagagataccattttacagatgttagattgtcaaagaaaaattcttatgtcatcaaacattactaagatatggagacatggggaacttcatatgctacttaatggaagtagaatttagtaaaaaccagttggagaaattttgacaatagatagcaatgttgaatatttcatgtcctttaaaattcacaaatttcagttctaagtatatgcttttgaaaaactcttgcatatgtattttaagagatgtatgcatgaatatttattgtaacaatgtttgtctaaaggtgaacacctggaatcaacctaaatgttcattcatcgaaaaatgagtaaattaattgaagtatagtcataatgtgaaatactctacagtagttctgcttttcatttcttttatattccagtttcatcatacttttcacaaagtactgtaaccattaagcaccaaaaatgatgtactaggtgatgagagaaaatcaattttgagtagcgaaggcttgagcagtaagaatgcaaagcactagaacaagaaaaacctgagtcaggcgtgatctcatagaactgggaaaaggggttgtcccaattcaatgtatgaataagaagagtcctgcaatggaactatgaagtgaggcttatattagtgtaggagaatcagaagaaaacatggaaggtggactttatctaatatcaatcatctcggcattttcaccattcattcagctctggattaatcatttagcaaaataaacagatgcaccaagaggaaagggtactaaagagtttccctgaactgacctcagttatcatggccaaaagtatttcactacctcccttaactttagtctatttttttttatctttatctgtcatgtttgacttcaattttcattattaaatggtttttttttttttttggcatggtgagtgatcaagtttagaagtttgacttgaaagttttgtcagatactgcatttgtttgagagatactgcatggcttgagggttttgcttccatcacagcacagttgttggactgtgctgaaggcatcagttggcctgaatccagcctggaacttattgattaattcatctcatgtgtttttaaaacctcccatgtggcaggcactgtgatgtcactgaaaagacattggcataatgaaaaggacttaatcctacttcccttcaagtttataatagttgatgtgtcaagctgataagtaaagaggcaatcacaatgcaatgtattaaatattgtgataatctgtttaatcagtactcttagtcatgggtcagacgatgtgtggtagtgacattgacccaaatgtcttctttccaccagaccgagttgattttacaggaaatcagaaaatgaaactgaatttttttttgagaaaaaacaaaagtcacactaggccataattatttataaacatatatatttctacctttctatttggagcagcaattctcaaaccataattgtttaattccaacttctattgtatgtatgcatcctccttgcaaccaaaggtaattatctcaaagcacatgtatctaaaatttggattgggactgctaaaaccactctggaagtgctgaaactacaatacaagaaagaatgagtacaataccagtgtgggttgttaggcataaacaacaagacctgaatagaaacaacatgaatcagtagctgtaactaagatcgttataactttgctacaactgatataaatttatgaatcctcatttaatcttacaattgtttgaaggaacagtttaaaattttctatcttcaaagttaggtttaggttatgggtgggagaaggaggcattttttttgcatccctgagaaactaacactttatctgtatctgtatatctatatcatttatatctatatttcttaactatatctatcttctagttcatccaaattcacagagacttgggctataaataaaagatctgtgtaatactttaaattgtccaaacattttttcatttattatgataggtaaaggtgagtctgactcttaaaaagtgaggaaagtgaggcttggagatattctatgactctcccaagatcatacagctatttagtggcaggatgaggaatgggccttaatggtttttcaaatgtgcctgaggaaccccattattttttttgagagtccccctctgcgctctgtcatcacccaggctggagtgcagtgcctccttctcggctcactgcaactgccacctcctaggttcaagcaattcttctgccttagcctcccgagtagctgggactacaagtgcccaccaccacacctggctaattttttttttttttgtattttagtagagacagggtttcactctgttgcccaagctggtctccaactcctgagctcaggcaatccgcccacctcgtcctctcaaagtgctaggattacagtcgtgagccacagcgtccagccccaactcagttttaagaggacattctacagctttcgttagtatagtattttgtacttacgcagtagtattgatatggtagtattgatatgatatggccgcttcccccatgctgctcttgtgatagtgagttacttctcaagaaatatgatggttttataagaagctcttcctctttcgctcctcactcttctctctcctgccgccttatgcaggaggtgcgtgcttcgccttctgccacgattgtaagtttcccgaggcctctgcagccatgcagaactgtgagtcaattaaacctctttcctttataaattgtccagtcttggttatttctttatagcagtgtgaaaatggactaacataagtatgttccctcttagaaagctgaaaactatcatttctatttttaaaatgaggaaattgaagcttagaataattaagagacttcctgcacaagacatggctagaaggttcagctgccaggaccagaagtctgggtcttaggcttctaatttaggtgctaaagcaatggttctcctgggactgaggcattgtggggtgcctcagtggatgtcgggggacatcactaaatattgtaaattttcaaaggaactaaagtaacatattttggatgtacatgaactactaatgctttcaaccttaggttttttaatgttctatttggttgcattatatctttatgaagctgggttttgtaatgataaaaagtggggagcacatgaaaatcattgaaaatcatttaggaataggaaacgaagatagcagtgtcccatcagattccaaagtctaagaagttgtactgtgttcagcacgcagtgaggatttaagtacttatttaactacttaataaattgtttggttcagtgtgctgtgaaaaaatttctgtgagattaagagcattgtaaactgagaaagcatgtcttctctggggacattaccccgctaggattaaagtcctaaagaaattgaaattgctggatgggaaggctgtacaggagggaagaactaacaatttattggattggtcttgcagaattctggccaccttgtgggcaccacctttttttgcttttttatctgagaagtaaacattggctacagtggaaataaaatgacacctagtttagcaatttgaaagccaaggtcatctttacaaagaaaaaactgtggatatcctcatactgcttttaacctgtccttcacatcagggagtgcaaaatctgatagatatcttgctggattatcaaacttcaaaaaccactgcaaaaccagtatggcacatcatccctaacacctgtcagtgcttgttgttacctcagtctttgtcatgtgctcactgagaagcttaaccgtggcaataaggtttccatttctttaattgtcattcaggggttaggttttttctccttccaaaatctaattcttgaaatgatttttatatcttgaacacttcctcctcattgctgtacagacctctaaaatgtgcctttttatgaaaactacacctgacaataaatttaccaagaagcatagacattttaaaagatcaaagaaaatagggattgaaatttgtaagtgatgttatcttaaacaaaaatgggtgaaactgatatcctgtgacattatggagtgctacgatactttttactctaggaactagagaaataaaagtcaaaagatgagggacagaaatctgaaagaaatcagtttcaatattctttaaacagttgccttattgtgagttaggatggaactagagtcagtataatttcaacaaaaaaacctctcactttaagtttataaatatgtacattacaggtgctgtaacttcttaatgtgcaaaagttctcagtcctgaatatgaatcaaatcacttctggaaattaaaaaaatacacacatgccagggacctataccagacttaactgaatcctaggggttaggacttttgaatctatgtgtaaaacacaattgatagacagtcattgaaatcaggagattattgaattagatgttgtctggcttagaactttagaccagcagcattggtattgcttgggggcttgttagaaaggcagaatttcaggaacttccctagacctactgccctagaatctgcagttcaacgagattcccagggattagtgtgaaagttctaggagcactgaactaggagagacaaacacgaaactgggattctgggcatttgtatgccattgctctgtcacttctacaagtcgtatatcctttgtgagtctatttctacaactaaactaacagacataattatacctttccaactgactccaagactgttctaaggatataaaatggaatatggaaaatatgtggaagtacttaaaaagatttaaactgcactgtttatgtaaactgttactctaatgtgggcaatagaaccacaaatgtagagctactttgctcttcaatttattccacctctatattttgagccacatccttgattgctacatagtttgccacccccccacccccaacacacacacacttatttagcctcccactacaagcgcccaaggtagcattacattactgttttctcattactttcaagtcataaggaagtaagaatacaagcaaaaggatagctcaattactatctggaatatgctatatacattaatgtaactctgtatttggaactttgggaatgaaggattttagtaaagccactttgtcattatgaatcccatagtttctctctttgtggtgaattaaagtttgacacatgttttcttgattaatggatgatcttgtcatgagtttctttgtgacagtaaggtgaatttggtactggaactctgtcattcatttcttgggaaataaaaactggaagaacgtaatcattagagcttgcctgggccctgttctcccatcttctttgctccatttcgaccacctgatgctatttgggggttcctggctttttgagccaccctttacccccaggcccttcctttcctaccaacctccttctaccagacccccatcctaactggtggcctagagcttcctcagtacaagcttggattcacctctaattccactcttcactttagatggctaagccagctataaccccaaggttctgttctgcctctgctattttgaaagtatttttctgcatgcatttggcgttctgtaatatctctcagtattctgttgtgctggaggcaaattctaataaagtttaaaaaaaaaacttttgcctcttctcccacataccgccccccccccctttttttttttttttttttttttttttttttttttttgcatttcttccacctgatattgtgggagaaatgcaaaaaaaaaaatgaataatacattcattgctccacatgaccctagcttttccatgctaaagtcttttctttgaattctactgggctcagttaccatcttttgtgctcagattcattgtatttcccttcaatctgatgtctgtctctaatttaaagctgtgtattcctcagccatctgttgctaagggcagaccttaggataataaagtatttgacttcactgttcacatgtttcttactctcatttcctggatggtggggggcactatttaattctgtcaagagacattgtcattctggaggtataatatcttagagtgcaactagaaagtcagccctgaggaaacaaaaccaacccaggctccacatttcctctgatactttcttgtcaaaaaagaggtagcacaaattagtcagtcagtcatccaacacgattttgagaaattgtacaaatgtcttctctttatacctctttgtggtgtctattacatgtatggtacacatatggcatttccagcagaggtttttttgttgttgttgttgttgagatggagtcttgctctgtcgcccaggctgaagtgcagtggcgcaatctcggctcactgcaagctctgcctcccacgttcatgccattctcctgcctcagcctcccaagtaactgggactacaggcgcccgccacaacgcctggctaatttgttgtatttttaatagagacggggtttcaccttcttagccatgatggtctcgatctcctgaccagaggttttatttttatatgagtaaattcagacaatgtatcacacgtcttactatttagctacatagccacaggctaacagcaactagcaatcagattagaattcaaatgataacaacttattatttgtatcatttgaatttaatttgtttgcaaatttcatgagatcgctcctacacattattctgtttttcttagtgtttagagagagtacgaaatccaatcagtaatcatgaggtatccattactttcaatgtcaaaaatcacaattacttttgcattaaactaatattattgaaagatttaagagaaatattaaaataaatgaatcaaaggaaggtggatgtcctaggatctcacatcaatttggtcacttgcatttgggtttcattttaaagtatgagtagtttttgacagaaactctgtgcagtattcccagaaatatttcagtactaagacatgtgtcaactattcatgctctgaaattcttactgtcaattaccttgaagtctgttgtttgcgattatctttttgtcactgtgttttttcctccccctgccagactagattgttttagctcatttcaaggatctctgttatctgatagtcacaccatggtagagtttcctctcatgttgcatagggatcacttgtgtaagctataggatattgtggaagtaatggaatgtaacttctgaaactaggtgatacaagacattgtggcttccttttgcttttttggcttactggattttgggaaagccagctgacatttcgtgaggaaaaccaggaagccctgtggaaaagcctgtgtggcttcctgccagtgaggaactcaggcttcttgagaatagatgtgagaataagctattctggaagcaaatcccccaactccagccaaaccctctgatgactgcagccctggctgacatcttaaatgtcatcccatgaaagaacctgagtcagaacttttcagcaaaaccattcctgaatttctgacccacagaaattataacacaataattgttgttttaagcagccaggctttggaataatttatcatatagcagtaggtaactaatgcatagactcagtatcatcaatatgaagatctctgaactgaatgatagtagacaaatacaagccccatattaaactgctaaagaaattaggattacccatgtctagttgatttatatttttgtatgtcttaaaattactatccattaattttatggttaaatacaatttaagttaaaagtaaaaaatagtataaaatcaaataaagaaggaattataaaatcataaatagattattagaagactttaaataattatagaaataattattctatctctaaataactgcagaaattagcaatctctattcagattgtcaatttttgagatatattaaagaaagtaggataacataactaagtgctatttaccaatactttccagttctgtgtaaagttaactgaacatataaaacatattttctcctgctattgactttttattgtcctgtgcctgtagtaaatgtaaagctgctatgcttaagggtataattttgtgcaggaaaccacaatatggtctggaaataattgccacaaagaccaagatgaaaagataaagttaacaaaaatcatttgacatgcctatcaaatctgttctctgaaagaaacatttcaattatttaatgatgaaatcaatattagaggaaatgctatagatttcattttgtcctatagccaagcaacaattatacctctatatctgttcttactttaggcagaacaaattaaaatagactcttaaatctttctttgagtcaagctatagaaaatttataaatttttagtttttcttggctttacatatttctattatttccatctccccattcacaaaatcaatcactccagatattctcattccatttttctttatgacgttataaaaagtaaaacaaatttgggccaaagagtgtactattattatgggaagatgctgacggtcccctggggtgccacacagaaaccctggaggaggtcttggcatgcttttcctgatcccagctctctctaaattgaggcccatggggtgttcagaggcagcatgcctagcccaagagttcctgtatctttttgcactttatttggaatgcttaggttactgtaaggctttcttcaatgtacctgaaaggggtctatagttttccattttaactcatctgtgcaagagatctttgaggaaatatgccaagtcctttgtttcatctgcatctttacaaaagggtctccctgagccaaagtaggggaatgttctctgtccacatccacactgttgcaaagagtttgctcctcatatcctacaagccctgccttgggatagttcactagagcaccatcaacatttacttggaggatttaatggagagatcccaaaaaagtaagacccaaagatggttctggtggttaattctttgtcaggaacccctcctgaatatagaaaaacatatgaatgtgaaagaaatggggataaaaagtctgatttcacaataaaaacgaggtatcattctttcctcaaatatttattgggcatattactgacagacagctcatgtcatatgcagagaagaaattttaagacttgttttaagtagaaccttaaaccctttaactaatacagacatagatttgccaataagaatgcagaatattaaggcatcttttgtttgtttttttcagaggagccctcagcttttgttgtgaaattgttactagaaagataacatgctatcaacagataaagtcaatgatagggctccaaattattaaaaagtgttaatccccagctctctattcaatatattaatctacataggttcaacatatgaatccatcattatttgaataggacttccattaagtgatgacttggtcaacatcttgacaattcacttttcttgttatgattttgtgcacaaaaaattgttgctgaatagagaaacaatgaacagtaacttcagctggtagaaatccaaagccctgttttccacagacacataaaattagttgagggtagccaatattctaacctgtacagcagtctggatgtgctctgtgggcttctgttactacatcccgtctgcaaaccaggtgcacaaaaccttgcaaggaagtgaagtctggttagtggtaattaatggagttgtttggtgaataaagtcaaagtagtagcaatatattattctgaagagtgtaagaaaagttatcctgaagctaaaacaagaccttgcaaatgaaagcttccaatctcagtcaacaaggatattcttacactcaattaaaattcaatgtctaattatcaacccctgcttaaagaagaggggagggaaaaagatttttatggggtggataaaatgttccctataaagcaaataaggcaaagctacttgtgctgatgaactgtgaaaataatggcccactaaacaacttactgtgcttaagggctaaaattaaggttatgtctcatttccgctctccaaccgtatgtcctctagataagcctggctcatgattggtgccggaatctacactttatgttctcctatatttgaaattattttctgtaaattgaatcataatttgaatcttgtttaaagattaagatgttagtgcttgttaagaaaaaatggaaagaagtattagaaggcattggttacagataaattaattatttatgctgaataattattaataaataatttttctttcataaaatggaaatgtgttaaaaagtaatgagagtttttggagggtttatggattatatattcatataataactctaagcctctttataataatcatgtcaaggacagttgaaggataatgattctatggctacatttggattgagattcaaacaactgtagtcaacaataacttaattggacatttaaaaataactaaaagaatgtaattagattgtttataacacaaaggataaatgcttgaggggatggatacgccattctccatgatgtgataatttcgtattgcttgcctgtatcaaaatatttcatgtaccccataaatatatatacctactatgtacctacagaaactaaaaattaaaaaaatttaaaaacaaattcctaaacaggaagtgaaacaaaaacaaaaaaatacaagaataaaaagaagaaaaaacctccaactttcttacaaattggaaaactgtcactcttatatattaaatatttagacaaatttcctgctgttttggataggaatcactttctcagttaacaagtgcgtatcagtacatactagatctttaacactggcccagactgagatactatgatttgtaacagaaatatctgggcagtttgtaaatgcagatggctgggctaaggcaccagaacctgttattagcccaatttgagcctattattctgggggagttataaggaagtgaaacacctaagtgagacactttagtctttccatagggtgtagagtcggataggagaaattactgtataatttagaaggctagatctttacacagatacaacagcgggtaattgacaatttgtaattcacctttgactataaatggtacctcctaatttttccccattggaacagtaaactgatgattaaaatttattcagtcagtaagaggtgatatattacttgcctagaccagtgatgcttgatattttcttgatgttagtcccctttcgaatctgatgcagatttgaaacttttacaaaaaaaaccttttaattattgtattttttaatcaaaaagaaaaaattaagaatcaactacatacattcaaattatggcacatatactgtatatatatacatgtatatgtatattgtgtgtgtaagtgtattatatatataacaaaagtagtaaaaacttctacttttaaacaaagaagaagaccagttatttggtttcactgatgggtgaatttacatttattcaaaaatgtaaatgaaaatttccatgggaagtgtttagaacacaaacagaaatggaataagatgaatactggaagacataaacaattacagagaaaagaaaaagacaagtccatgaagtagaataacaagcaatagccagagagaaagaaaagataccagagagtattatgacagtgatgggagagtttatcatcaaggactagctgagcattagcagaaagtgttattaaagtcagttaagataaagaggtcaaccatgaggttgtctgagaagtaaagtttctaggacttgaggacgtcaaagatctatatgaatagagcttaagttgtttttatggattttgaagtcctctgacataatagcagggcttgatgtgaaaatggtgactgatctaggacttcttcatcccatgtgagttagattctgggaagtggtgaaagatagcaataagtaaaaaggcagattcatcctgacatgcaggttcaagccaaaattgatgacagacaccaaacaacagatcaaggaagctcacagaacaccaagaaggataaataccaaaaaatctacatgtaagtatattctattcaaactgcagaaaaccaaagacaaagagaatgtcttgaaagaagccagagggaataaaacaccttacctataagtaacaggataaaaattatgcaaacttctctatagaaagcatgccagcaagaagaccgtagaatcaaatatataaagtgttgaaagaaaaactcattaacctagaattctatatcccatgaaatgatctttcagtagtgaaggagaaataaaaatttcttaggcatttcaaattgacagcagagtttgagaaccactggtttagggaaaggtggcttatattgcaagaatgtatgcaattattctcataagtaactttggtcagaaaattttaacttaaatttgtccacagctcttcctcttccactgaccactaaaaagaattttggctttgtgagctgtttctctccctcttagttttttggagtatcttacctaacacaaaaatcaataaaagattgggtagagaaaaagattaaccctgacttagaaaaacattttattttttctcttgtatgtgtgtattttgagagatagcaacataatagcaatatatgaactaaatgaggaaaacttacaagctagaaagggagttttcaaataagtgttgtagagtttatttctttaatggtgtttgaatgatataagtacataggttgtgttaccttttacttattgctctgtgttctgtctctggtgtaacactggatgagtgggttatgagttgaataagtttatcgtaaagatatattccacaagtatctgataaggttttccctaagcttgttgaaatcaccatatgtgtattaagatttccattaccatatagttgatagggatagaaattttgttttgagtgtgaattgccacatgttcagggaggcttctacttgttttggcaagacatggcacaaacatctcacgggaaaggctgtctcataccacttgatatatgatttgcagcatattcattactaggataatttgaccacagagatatcaataggttacttattttcagaaaaattggacaattaaaaaaattatttcacaaaagggaatatattattgtcattttaatgaaattcagttgttgcacaagtttgtctgaaaactaaaaatgtgccttgagcttcctggggtcaaaaataaaataatgttagatattaatcaagcgttatttcttccccttaccttctatccatttttctttgattttattttctccaagtgaggatatagcagatagattctaggattatgaaaggcattggacttatgtaccttaagagtttgaaactgttttttgtttgtttgtttgtttgttttgtctgtttgtttgttttgctgcttcttttgggagatgagttggggagatgaaaagactgaattcatgctctgttataaaactttcactttgactgttactttttaactaaaacaagccatgaacaggctactaacctagagataggccaagcgatttggatctcttagcaggagtggtgcaggtctagagtaaacactactgtgttcattgatctcttaatacagatggaacttctttatcccagcaatcaaagactccatccagtgtaaagggttggaggaaactgggaaatttgggcatttgcttattccttctgcatagaattaaattatgtattatgacaacaactaagcatattaaaaggacacacacagatacataatataaacacacatatataaaccatatatatacatatataaccttatttaattaaaaaaacctgctaaattgtataatacatctgggtcaatggatatacctgccaaacaggtaagttacattgtataataataaaatgcttaggtatgaaacccaagtctctgaagcctcatgtgctcctctttcatcctaataccttgctctccctacatccactatccttaatgttgtttatcattagcttgctattaaaaatagtttttctactatgtattaattcttaaacaatcgagctttataaaaatgctgtcatgttatatatagctttctgggtcttgtttattttaccagtatgtgttatatgtatctgtaacttatccatgtttttgcatttcctgttgatgctgaagaacatttcagtttccattgttttgcagttataaataatgttgctgctctgaatacttttatacatgttttctgttgtacatttcttctggtgcacatatgttaaaatttctctgggagtttaattgctgtgttttaaggcataaacatgtttaactttataagatagtgcctaattatttttaaaatggttacaaaaattcactttcccaaaaataatgtatatgggttcctgttgatagatattaccctctaatattagcactatcaaacttcttaatttttgctaaagtagttggaaaacacacattcttcagaatgtagaagagagggaaacactgcttgattcattttatgaagtcagaattattcttttgatgaaaccaaagacattacaagaaaggaaaacaataagctgatatttgtcatgaatacaagtgtggaagtcctcaacaaaatgtcatcaaattaaattcagcaacatttaaatatattatgatgccaaaattgagtggatttactccaagaaggaaaggctggttccacattcaaaatcaatttggtcattcagaaagccaataaacaagaaaagccaaatgattgtatttatacggaagaagcatttgacaaaattcaaaaaccactcatgattaaaacagctgacaaactagcaataaaagagaattttctcaacccaataaaaggatctgcaaaaaaagacactaacataatacttaagttatgtgaaagactcaattctttccatttaagatttggaaagagaaaaatgcactttctcacaaccactcctatttaacatcatactggggatcctaaccaatgcaataaggcaagtaaattaatagttatataaataaatgctataaatattggagagaaaggaataaaactctgttcaatgatgacatttctcattgtctctgaggtatctacaaaaaagataagaattaaaaagtgagtttagcaagatcacagaatacaaggtcaaaatataaaaattaatcatattggtatatactacttaagaataatttaaaattgaactgaaaacctgaaaaggagtataactcatggctagctactcattaattcaattaacaagtttttcctgtgcagtttgtgattaaaacacttagtcaggacttgacttggattttcagatcacttcaaataaaataatttgtttattgggttagacttctcatgggtcaacgttctcctagtctcattctaagtatttgatgatgcaatcacaactcagcagttgttatatttaatacagattgacaagagcctttatttccaaaaattggtctgaaataactgtgatcaagttaaaataatctgataaataaaacagaaaatgcatctgatctgcatcatggcatctcatcactcaagagcatatgcttaataagttacaaaaagaagagagaaaaagaaagatgtcctgaatagggtggtcaaagatgacagttaaaaagacctccagatctctttggaatccaacatatcactatagatttcataaaacaataattgtctttctgaattgcttacacggtaaacgaattattaaataataacttgaaagtgaagcacagatgtgatctggctgtggttcacctattgtttacttttaatggaaatgttttttcttcaaatcactgacttgaaacatggtggatttctatctgtaatatagacttctttcagtctatgttttacaagttacattatacactatgccatttccacattcatagactaccaaagtgcttcttccaagttgccttgatgatagatgtaccttatatgtgtcttcactaaagctataaagcattgaaatcttttctcaaggccttcaaaagaggaagtaattattttcaagcctccacgatgtcctaagtaaaaacatctggtatttctgcactcactattacagtaaaaaggaagccacactagaagctacccaatttctgggtacatagttacttagagactgttatatattccataatgacataattttggtttttttcccttatggatttttctatatacattactttgtttatttgctcatttgttcctcaaatatttgagaacttagtatgtgtcaggcagtgaaccaagttacatgagtaattgtgtaggaaacaaagtgaaaaagattatacggaattactccctaagaactaatcaatccagaataagcaagatctttaaatctataggtagtaaaatactcagattagttctgtataacaatctgtataacaattagttctgtttaacaattatatacagtaatgttacttttccattctgctctctagaacagaaatgataaaaaagatagttgtcatggggcctaagactatcactattttatggcttgaatatcatggccaattttatttattacttgtttgtttcagagaagaatgccagagtaaatgtattagacattaaaaatatgttgtgagaaaggtagaggtctatctagactcttgttgctctgtcagaataactcaacaatatacttgagttggaagaaaaagaggttgcccctgaaggcttgtattggattgttgctttatcctgtggatgggtagcatcagttcagagacggaaaaagaaaggattcagcaagtgaagtctaagaagcttatgtcagaaatgcttggtattcgtgtccttgaattctgtatacccaaaggaaaaacaaggtaaaaaagcatggaaaatttttttaggcagtttttgtagttcaaaaccagcttgtttgctttggtggctaactctttttaagcaaaaatcccagtttttccagccacagtacccacatcattcttcagaggagtatactctctgtaatatattaataaccaggagtgaatagttgccacaaatgtggagaagagaagaaataaaacttaaaacaaacatatttcttttgtatgaatgatgccatcggaaaaagaattttattaaaagtagaggcaagacttagtacacataaatggcatctattagtttgtacaaggttgttttgaactcacaatttaagtctgacattctagttagcagagtgcattattagaagtctgcaatctggtgatctcaatttagataaagccaataagaatatatgaaaattcttaataggatttttagatgaatttaagtatttgcaccatcctagtagataagaaggaaaaacatcactttggtaatagttcttcaaaccaaaggctcttgtgtggccagacaggatatatttaaactccaagaagtatcgtaatatctatggaaacatatttctgttgaggtaattgtacctccagtaaaagactatttgaatcagcttgagttctgccctagctctctaagaacacaatacacattctgcatttgttaagtacagaatatgaggtcacatatcaaatagtaaggattcattgaccatgagaagaaattttaggacattaaaaacttcttaccaaagagtatctaagttcaggtaattatgcatttctttttacttcatttcaggaggtaagccagactataagaagaggagaaatggcaaagagaccgaagaagaggcattgcaatatggtgtaatcatataatagaatttgggtgagaagtacaatttgtggtaatatatagtcagcacaatgaagagtggattccagaaatacaagttcttgctttaggaagcagttctgcctatgtcaatacagaattctcagacgtaaagttggcgattatgtagcttgcaagattatgaaaagcagtagcatattgcttgcttctaagcttgaaacacagtaggtctctaataatatctggcttccccttcttactacataaagcatttattgttcagtatggcaattatattttaagcatgctgcattatgaggtcattgaggaatgaaccatttctcatttacatttataacttcaatatcacatatctggtgattatagagcttaaaaatatcaaatggaagtagcagaattgttgtatagaaagaccatgaagggaaatatctcaaaaataaaatattagaagtattctaagcattattggtagtattacaatggtagtaatgttggcagaaaaagagtcagaaatggttttaaaatgtgttgaaggatttgaaagccaatgaagtacggttcaggagagttgtttatcaagcactaaaaatgttcattgcttctcagcaattctgtaagtatcaataatgtacttgactattcgaatcccaattgctccaagaagtctttccaagctcactggatcaaattaactctccctctttggcttgctgccacattcacagtccaggatatggtcagcgactgttcagtagcaacagagtttgttgctattgttgctactgtgttccacccactgtcctaagccctgaagatggagctgaataagacagtctgtcaaggatcctgctgctatggagcttacatccttgctgggttactaacattagactgaaacctgattcacacttagttccttatttcaactgtataaatcttgtctctgttttttgaattcccaacaaaacaaatagttccatgaaaacagaaaattgtcatatccttcttccacagcatgaaccctttttaggaataaatgtctaaaaaacaagcaaaataaacaaaaagccgagcagctggaaagagacagtaagttctcaatttgctgctatcagtctcgccattctaccttggtgtcaattggatagattgaggttaggagatagagatgggttacttaggcatatttctaaataggaatggttgaagaaactttgaagagagaagtggttaataatcaaaagaaaatactttgtgtatcatgtccacagtgggtactcaattgacatattttccaaaatagtgggttgtcttaattatttgtcatactttttaccatgtatcacaatgttagagaagttacaaaaattttttttaaattctgagttgtcaatgaaattgatccagtgaaattccaaaacctacatgttcctaattattctacaagctattgagatgcagctgaattctttttatccccttggatccactgggcatagttatgatgtgacgtagctgagagattttcaaattcattttacagggtactcatctgtggtatgagtattatccagtacaaaaacaaaaacacaaaattatttaactataaaagctattcaacaacttgaaacaaaaaaaatcatagaattccccttttctcgtttaggaaaaaaaaaaagtgcagctcactgaaagcactcatttaattttacataaacatgctctttaaggctaaagcaaatatgactgatattcaatgcgaaaatacaatataaaaactgttcttggagttatttctaaacagaactaacatcagaattgtctgtttgggaaaaatcagattcctcaaatgaatcttcagtcaacacctgttcaagagtgatgatgtttaacatgcataagaatgctgtgttttttaggatttgacattttcagcaatctagagttactatattttgtaaatggaaataccactactaaaaatagaatgttaaatagaataatgtcttttgtttccaaatttggcatactagagcaatgcgaaagtcataataaaagtgagatatttcatggcaaatttaacttggggtagaagctgcaactgcaagtgctgctggggagtattcttggaacaaacaggaagggagttaatgaaatagaaaaatgatagcagaataaaatcttttttttgtttgttttttgtttttgagacagagtctcgaactctcgcccaggctggagtgcagtggctccatcttggctcactgcaagctctgcctcccaggttcacgccattctcctgcctcaccctcccgagtagctgggactgcaggagcccgccaccacgcctggctaattttttgtaagcaaaatgaaatcttaaaactccaagaaataattacaaagtaattaaattactcaaaaaaattatattatcatttaacatggagaaattaggttttgctcaagcagtagtatctataagcagtaatttacacacacacaaaaggtcaaatgaagtgacagaacacttttactaacaaaatgtattgacataattaagatgaaaaattatggaaaagattgttccttcctcaatatctatctctgtgtttccaaacataaaataaaatcagtgaataattccacatctagctttaattggtagtgcctaataatttaaggtgaaacacaaagcatcaagaaaaatttttaaatggaatctattaaagtatgctaaaattagactaaaagttttacttcactagattaaacccaaggaagatatcaaatgggtttaaattgtgaaagcgaatatgaggatggtaaacaaatcatcagtgcaataaagcagcacctcacgttaagaacgctgggcaaggcaaagttatatttctcatctccgtttccttttaactgttctttatggtgaactaatacaatgtgttttgaaaatacctgagttacctattatggaagaaacttagggtgagggtgaaccttggtatttgtgaaacagagttgaagccctagttgcaacttcttacatggaatagctagtgtcttagagggcgcagtcattcttgaagtgatggtaaacatcttgtcctaaattaggcagatgatgaacatactaagaggttttccagccttctatatggtgtaggtgaagaatttgaaggttgagagcaaaaggatgagagtaagacatatttctgtctccagtgtgaagaactgatctttctattatgcctagaaatgtgctcagagagtaaagttgaaaataatatataaatatgagcaacttcaaaacatcattatattgaacattaaaatttatagatactatgcataaacatttctaaaacatggaaacagtacgatttcaaaggtaagttaagggaaaccaaaacaaatagagaggttctaagaaacactctcacactcttgggttttatgaaggggaagggctaatttcccaagaaaacctctttgatctcagaagagaagtttcatttgcttgtaaagaatgacatgctcatacttggattagtaaaaatatttaatttggtgccagcataattctattgaacccttaatagaagctattttttcaaaatttttaatgttttgtgttttatcctaaattattaagtactactattaaagctagatgtttgaattatctattgattttatttcatatttagaaatataggccgggcgcagtggctcacgcctataatcccagcactttgggagtccgaggctggcggatcatgaggtcagcagatcgagaccatcctggctaacatggtgaaaccccatctctactaaaaaaatacaaaaaattagctgggcgtggtggcgggcgcttgtagttccagctactcaggaggctgaggcaggagaatggggtgaacctgggaggcggagcttgcagtgggccaagatcgagccactgcactctagcctgggagagagagagagactccatctcaaaaaaaaaaaaaaaaaaaaaaaaaaagaaaagaaaaagaaatatagagataggtattgaggaaaaaacaatcccttttataatttttcatctgacttatgtcaatgcatattgttagaaaaagtgtgttacttcatctttagtgtgagtgtaaattactcatcataaatgctgttgcttgagcaaaacctaatctctgcctgttaaagaatattacaattctttctttttggagtaatttaattactttgtaattatttcttattttatttattttctgtaaattaacatttactatcctcattgaaataatgagactaaacatatttctttttttaaatttaaattatgtgtatttagtatggtaggaaaccccaagtatgactaattttaacagtgaatatatattcatgaaattaggcatcctaaaaatataaaatttgtagcagcaaatatataactgttcccaaatattaatgacgtaaagaataaccaaagattctgagaactacacagtaatttggttttaaaataggtctttaataagaaaaatatccattggccttttggactctgtggataatagtaaacatatgaagattatttgagaaatataaaggcaaaataatagttttctacatgatttttatctgttcaaagaaaaatgaggaaaaagtgataaaataaaatatgattgaaaaagggaaggaaaaagtaattgcaacgatctactacagtggtttagcgtcaatattgaagtaataattttttgatatgtagaatctaaggaaatcataggctcaaaatctggaagatatattggggtagaggaattaataagagaaagagttgcacatttaaagacctggaggcaacaaaggtcatggcacattcagaaacctgaaataaattcagtatggctggacttatgtttgattcaacaaaacactaggggcatttctctagtgggtattgagcaggtgatcacaatgaatctgtggtcatgatttgtgaatattcatgtgctctttaactacatatatgctaaataatgttagtaaatcaattcttaaattgcctattgaacagtttacaaaatttaagagcaagctaattctatcttagcattactgtaactggaagcaaacattcttacatatccagagcaaatgataagaaagatagcagtttaataagaaacataccaatctactttatttttactgaatcaattacagccttaaaatgtaatatacaccaacattttccaaataagcatggttctcaaaattctttgcactctaagattggtaggattttgttataacactattcatgattcaacagaattcatataatactgtttgatagttcatttattaattcagaaaatagttatgaaaacataccttgtgccacaaatgacccataagcatatgaaatgctcatctttattaatactcatggaaataaaagttaaaacatcaagacaggttgatgaatagatactaatatacagctaatataaagaagaaataagacctagtgtttcatagatcagtagggtgactatagttaacaataatctattgtaactttcaaaaaaagctaaaagaaagtaattcaaatattcttagcataaagaaaaaaataaatatttaaagtaataattatcccagttaccctgatttgatctttatgcattatattaatcaaattatcacatgtatcccaaaataatatatacatcatatttcaattttaaaaacctgggaagaaaatactatcaattgtaaagcaaaatagttaaagtaaaaacgagttatcttttcacatcattatgttactaaaaatatttttttaaagttctgaaaatacattgttggtgaagatgtgttctaataagaacaccatgggagtataactattaccactatgaaaactcattttatatcatcttgtaaagtagtaaatgcatacacccccaacaattctactcctaaatgtgtgggtactagatgttttcacaatagtgaaaatgaaaaaataaaaataaaaataagcaagcaaacaaaatttagatcccttaattgtagaatgaataagtaattaatatttttataaaaacatgcaacaatggaaatgaattaacgacagccaaacttaccaatatggatgagcctcaaatccaatcttggggaaaaagtcatagaaaatacatgtagtctgattcctttgtacataaaggtcaaaagcaagttgaacttgcttttgctcttgcttttgaagctgtaagttgtctagtgatgcatccgtataactattatgaaaaataagttgttgataatcacaacattcccttttgttattatcctgtcctgtcttcctttgatagcactatttattctgctttttgcttctcctgtcctctacttcatctaatattcacctgtttcaatcttaccatttttttttttttttttagacggagtcttgctctgttgccaggctggagtgcagtggcacaatattggctcactgcagcctccgcctcccggattcaagcaattctcctacctcagcctcctgagtagctgggactacaggcgcgcgctgccacaaccggctaatcttaccatttttaatatacaaatttgaatgtcttttcctctgtgatttgttttcttttgtaatgcaaatttatcatattacttatcacattatatctttacaagattacttgtttgtggttaattttatattgcaaccacctcagagacagagattacaggtctttatttttacaatcttagagcctttagcaaagtgtccagcatatactacaaacacatacatgtttctttgaattgtatttcgacttaaagtcagtttgttgtaaaaacctttagcaagcctcataatgaggtcttagcgtggaggaacactttgctggatatttttaaggtttaaataaaatgtaaagtgagaaattgttttagaggcaaagctatgaaagtaaatataatgaaaatggaattaggaaaaaggattcactgtatggatgtatgtgtgcataagtaataaatgtgcatcactttcaacatataatcatgtaacaatagaaacgtttccaaacactttattgtcaaattatactcaccaaaaaattagtatatacattttaaaagctttactttcaagcttattgataaaactttactatgaagaaatagtgttatttcttcaaatactgttgtaaaattatttttgttgtttttaaccttgtagtacagccaagagcttgttccaggagtaaaagtgccagttctacaactttttggttattttcttttgcttctattagtaatgttatttttattatggctatttatagaaatcttttaaagccatcttgttaggattagtttaattaaaaataaataatataacttataagtctacttaattggccatatgtaaactccaccatatgctaatatgctaaaagcaaagaaatctggagggagtcaccctcctcttccctcacggtgcctcacctactatgatttctctcgaccatcagacaaaaggtggtgtgtttattagatattaggaaaacttagtttctgtcttgcgttttcgttaaaatatataacaaaatttttcttgtgtcacacaaattatgtggctttgcacaccccacatttgagcgcttatgaattaatctcataactttcaatggagggtggggagatgtatgatcaacaagaaattttttcaaaattgtcacattcagattattgcctcttcactaccccagttaaggaccatcatattaggttatagtggtcttttactctaatataaagaaaaagaaaattccaattgaatgagcataagtttgaagatagatgagtggccagtttaatactatcaaacaacagtagttccccaaacaggattttttaaatgtgtttttttcaactccatctctccttcccccacttcttaattcatagagttaaaaaagaaatgtcataaaattatgtataggctataatcccaacacatgggaaaaaatgtcaagtgagaagagatgggaggaaaacaccaggaaaataaaagctatagatcatagaactatgaatttcatttttatgaacttcggattattattgttttttttctctctttttttattattatactttaagttttagggtacatgtgcataatgtgcaggttagttacatatgtatacatgtgccatgctggtgtgctgcacccattaactcgtcatttagcattaggtatatctcctaatgctatccctcccctctcccccccaccccacaacagtccccagagtgtgatgttccccttcctgtgtccatgtgttctcattgttcagttcccacctatgagtgagaatatgcggtgtttggttttttgtccttgcgatagtttactgagaatgatgatttccaatttcatccatgtccctacaaaggacatgaactcctcatttcttatggctgcatagtagtccatggtgtatatgtgccacattttcttaatccagtctatcattgttggacatttgggttggttccaagtctttgctattgtgaatagtgccgcaaaaaacatacgtgtgcatgtgtctttatagcagcatgatttatagtcctttggttatatacccagtaatgggattgctgggttaagggcagccagagagaaaggtcgggttacccacaaagggaagcccatcagactaacagcggatctctcggcagaaactctacaagccagaagagagtgggggccaatattcaacactgttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaactggtaccagccgctgcaaaatcatgccaaaatgtattattgttaatttaaaaaattggaaaaccacagtgtctgaaattaatcatgagtttatgcttaaatccctgtaggaaacagaaaaattcataagaaacttccataaaaatcaatttcatcaaattttatattaaaacagaagagtaaatatacacatgcaggtgtatacaacacaccagtggatgagaaagcagtttctggggctttctggaagagtggcacatttgaagccaggctgcccaagatatattctttctgtcacttaatttctcaggacctctgtttcattgtctctaaaacgagtgagttgaactagttaatctctaacccttccaatgctaacattatataaggtgtatgtgtctggaaaatttgcagggcaaatcaattttttatttgaaacaaatatcagaaggaaaccttctagatttttcttcttcaagtgcaattggtttcacacttattgaacattttccataggccagaaactgataggaactttacatgtatcgtttcaaatttttataaaaaccttcagggatgaattataatctctattttatcataagtaaattgaccatcaatgcaactaacaaatgactgagccaagatttgaatgtaggtatgtctgaccccagtgtttctattctctctaccacagtgagattgtttattgaaataaattatgaaaaaatgtattattttaccttggaggtgagggcaataattaaaagatatgaggactaataatgattttcattattgttggttatactcttatattactggaaggaatggaggacagccctttttctcaaactcagcaacaaagtttggtttggtttataaaatattttctacatgtgtttattttttattttcctgaatgtttgaaaactatcatgtgcgtagatgcaccatcatgtatatttattcttgaatctgaaattccatctaggtggcaacaagtctgttgcatattttatgctcaattaaaaagaagtcttacaagatttttatgtattacggaaagatcaccatctgtcccctatttaattaggtccatcctgattatgttacatgtgttctggctccctttaagaaaattttctacatatacatgaaggagaggcttgctaaaaatgaattgtcagcaagaaacaggagagatttaaacaaagaaactccaagaaaaccttaacaaagagaaatatctcaaacctgaatccttagattcagtaaaataataacccttccccttcacctctcatgacttctataccaaaatacaaatgcaacttgaatcctatcattttagaagcttcaagagttaatttttctttcctgttacttttcagtttggaacacctttatgctttcggaacaattttagccgggaggggaaatgccaaaatactatagagaaggctctttcttgggtaatttagactagatttgaggaagcaaaatgttgctataaattttatgtttaaaaaataactctgcccatgaaatttccagtgggtttaacagatgcaagaatttcagataacaataaaaaatcagattatcatgcaaaagtaaggaattgttagaggcttcaaggggataaaggataacgtattgagctctgggttctgagacttgggttctctcctttgctttgccattaattctctgatgtttcaaacatttaccagaattttcctaccttaaaaatatgtagcaacaaaatctccccctgcccagtcactagaaatatataagcattgtaaggatgtgaaaattccctttttcattcatttactgtttgccaactacacttcaggaatctaagttctggagatataacaataaataaaaagtatctactcttatgtatcttaaattccaggagtaaataaacaaataaacatatagtatgttagaatttattaagtgacatgcagagaaatgaatccatgtaagaaatatgtaagaaatattttcatagaatgtttacgaaaagcttttctgaaaagtgtcactgaagcaggtacctgatgagtgaatgagccatacagatatcctggggaagagctccctaaagtaggatcagcatgtacgaaagtcctgaggtgccctgcacatgtggattttggaagcactcagccagtgtactggaaaggagtgagcatgataaagtgaatgggaaaagacctattcagagtattagcaagaaacaaacacaattcctaagtctagagtacgtgtttatctgtgaaagaaatggtaaacagtaaattcattaaaaacttgctattctaccacaacataggagcatagctgaaagggctttgatactttagagttgcagaatttactccacaccaaattggtcaaggcaattgttaggaatgtaattaaaaaggagggaacatgaccaggcaactggcaaaaattttccgtaattacactatgcattttgaataattcaatcataattccaaaatgacgcttcttattcctcttctctttctttttcaagccttgtattgcctccctttcctttccattttcttttcctacctttccttcctaaccctcctcttccttttctttgcgtccccttgcttcccctccgaaaaggtagcatactgtatgatttcatttatataacaatcttgtcatgacaaaattatagaaaaggagaacagattactggttgcaggtgttaaggagagggagggagtcagcaagaaacaagtgctataaaagggcaaagtggaggattctatagcaatgaaaatgttcccctacctttattaattttaataccctgtttctgatgtcgtactgtagtttttcaagatgttaccactggggagaattagataaattctttattatttctcttgtgaatctacaaatatcttggaataatagtttaattttaaataatgagcatcatgatactagaagacattttgagtcaattgaactccctcactcacaacatacttcccctatcatcttctgctaatgctgccttggccccaaatattttctgatatgtttatccctagtgtagtaaacgatcattaccaataatttaaattcatctactctcctaagcaagcaagctgtgaactgtgatggatgagctttatatattgaggcttatgagtacagccagttgagaacagaaaaaacacttggatgaacaaagacgtttttaaaggaacacaataagctgatctaaagctcatataggatagaaaagggtcaggaaacatttggaacattttgatgaagaagaagaaattaagttgactgccctcctccttgccactttctatcaagacaatggtggtgcatgaatttttccatttcaacaaatcttctccaatacttgatgttattagaatttctattttttctaaactgatgagtatgaagtggtgtcttgtgttgttttattttctaggaatttgtaggacttcttggtatattctgaatactagtatttctcaataaaatatgctgcaaatataatttcccattctaaaatgtatatgagttcctgtactatatggttttgtctttcttagaaaatgttttgctaaaacttaactgcagccattaaaacctttagtcactcaaaactgtgtgtgcacagcagtagaaatagacaaaagttttaataggagaggttaaagtttcaaaaagtagacccacatatatatatatattggaatctggtttacaagtaaaatggctgtatgtcctagcttgctggtgatacttcccacttatgcctgctgtccaaccataataattaataatgtccccattcaatttcaaaagcttttcagtatatatggtcattcttttttttttttttttgtagagagagtcttgctctgtcaccaggctggagtgcagtggtgcgatctcagctcactacaacctctgcctcccaggatcaagcgattcccctgcctcagcctcccaagtacctgggactacaagtgcgtgccaccacgccaaactaattttttgtattttactagagacgggattttaccatgttggcaaggatggtctcgatctcctgaccttgtgatccaccctccttggcttcctgggattacaggcatgagccactgctcccagccatatggtcattctatatatgacaggagtagactttaacataaataagggtaccattggctatccttatcaaaaagaataaaactttatccatagcttaacctgtaacaaaaataaattggacatgaattgaaaatataaatgtgaaaatatatattcaaactttcagaaataattatgagaaaacatttacaactttaagttggggaagaatatttttaatgataggaaaacacaaaccatgttaaaatttaacatttaaatcttcccttttggagagcaacgtgacaacctgtgtacaagctcaaagatactcaaacccttgggtccaccttttgttacacactgaagaggttttttgcccttgtacataaagggacttgtagaagacaatttactgcatcaatgtttataagtatttagaaatgacctatgtatcagtttgaagaaagataaatacattatggtagctcaaaaaatggaatgcattgcatcagttaaaacaaaagaacaaaataaaaatttttacaaaatcacagggaggcagatcttgacccttttctctccaaattgactgggtcacctgtttgctgtgttctgcatacagggagtgctgaaggcaactgtacatttcatcaaatactatttctgtaaaagtggggaaaaacgggacagtagatattttttatagcttaagatttcttagcaaatagaatttttttaaaagcttgtctatagaatattgtgtgttagccaccaagtgatgtcttagatgtaatgaaaagtgtgatcttagaaaaaagttcaaggatacattttaaaacttaaaacacttcaaaaattgctatcctatcctatattaaactcataaatatctcatattagttcatacgaaactttggagctcccagaaaaaaaaaacacatggaaccagaatttaaatatatattgttttcacttttcttgggtcaatctgttatttacatatgattacctctaacacttgtattaatctaagattatttttactttaaaaggctttttaatttttatctatatttctgacttttgactgttgaaatgttttctctaatccattaaactaatatttgcccttgcctcatggaggtttggttatctccattgggcttgaagagtatttctgatttttcatcttttgtttcactactgaccatcagtttagcatggtgttaaaactgaatatcaagaagcaatagatatatcagtcctgaaaaagtaatctgctctctgagattggcaatttggcattgacgatgaggaaccccaccatgaactaaggctctgatctgtgtcataaatagtattgaaggtgcggggtggtggcggtcagttttaattttgcttcatcatctttaagctgaaaatccctcatatttctcatttctcttataaaaagcctcgtcagacgtctcagagatgacaaagtagttattgtgagtgtttggggcgggaacgatgacaaggaggtttcagtagaataatcaaaaacctatttttctctactttgcatcttgattagaagttggattgtgttgttgataatatgaattgccctatttggggactattaaagtatactttaaaaatatatttcacaaaataactgtactttgcattttattctgtgtttcttcagagacatccagggtgtgctcatcagaacataaactggcaaataccaacatgcttaatgacaatgtggcatgccatttgccttgtgagaagtgctgtatttcatttctttgactggctttggctgtttggtaattgtcagggaaacatctggttactgtcacatactttagcatccgatcttattgcatgacattttgttctgtgatatttggttcccacttgggactaggaattggaaacctcaaattaagttccatttccaacataataatagggaattgtcctgaataatgatgttcgaggttcccagtaatggaatttcaacacagcactttggaaacattggaaaaaaaatagcaaattgttatcagtaattttctttacaaaaatacaaatacataattaggcctcaaactgtttgaagaggctactctggaacttttcttagttttgaaaatattactctttagtttttggactcaagacaaattctgatgaactctcttacggtgaagtcatatacctacatacctttcattttccctttcaataactttttattttgtgtaaaaaaaatttagaaatgttccttttggaatttctgggtatatttctgtaacctttaggttttctgcaccataatttgtatgttcataggttctcttcactggttctccaataaaataaagtaggaagaacttaggtaattaccattttgcctctgcctgaacttggcacatagctcagtgctcatgagactgtaattcatattctggaaccagattggtaaatgcactcttaccattcaatactgttgcatctctccaaactagtcctaaaacttgctgctttcctcatctatttgctcctagaaagtgttgtgtgatttcaggtttctctaggagacttattaagctcacatgctattaagctaaaactgaagcaatcatcattcagagaaagggataagctatgtgttagttttctcaaataactcctttcctaaaacaaaatgcacaaatagaatatcttagaactaattctagaggaagtcgattttgtggagattttcacataggaaatttattggggagtgctcctgggagtctctgagagggagcgaagaaataggattgagaaaaggaaagagctgatataagactaagacacaataaatgtctcagctgattgctcaggggatgaccctatagaatcatccgcaattgagcaaggaggcatgatttatgagccttcactggatgtcactgccctgcgggggccacacaacttgcttttagctgttggggaataatgccttgtgtctaggatccaggcagtcctccagccatgtaccacccaggattctaaaatctgaattgttttcttagaaatagagatgataggtgtgtttgtcctcatttcccaatttatttatgcaaggattaagaatttaacagaacaggtggttatacagaatagaatattcaagatagatttgtccattttcttatgccccctattccctgtgggttaaagaattgtcactttcactttcaataaaagtgatgatttgtattggttggggtaaaaaactaaattattgttaaaccattgttttactaagacatgtaacttttctagaagccctcacggtagtagggctgacccttcctttcaaaagaacattatgaaatatcagtttctcttggtctttaaaccaatcatctaacagacattgtcacctccttaccacctcctgtggtaagaaagccctgtccatgctttggttcttttcacattatcttcgcctcttgtattctgatgcttgagaaagcccatcttcccaagagcaaaaattgtggttcaggaacaaactactacctcatgagctggccccatgcccaggaatccacagtgctgagagaggcatgactttaatataaaatgatgatctagtcaatagtcagaaaaagattttctggaaaagaaagaaatactacacaaatcaaacttgaaatctgtgtaacgaagtaatcacttgagcacatgtggagagtttgagggtgacccagtcattactttagcacataaggaaacttttaataaatgttcacaattgaccagaaaggggaggaaaccaacacgtgctgagcacttaattctggccaggcattatagaaaacagtgaacaaatacgataacattcaatgctaatgactgtcccaagtgttaggaatgattatccaagatttttgttcattctttttttaccttcaatgaggtaacttttctaagtttacttctagaaattggcagagttgggattaaaagttatgtttctctgattgaaaagtacatgctattcctcccaaaaagtatccacaatgtgagatgtgtcattaaagtgaaaaactttcattattcttagaattgcatttctgaaaaattgaacattgggctataaagaatatcattctgatttgttttattttttggaaagtacacatataatgggaagaagagtgattttagtcaggataccagcttcattatctagcagtaagctctgggaagtaaaatgaacttcaattttctcacttataagattaagatattaaagtagaaggataggctgggctcggtggctcatgcctgtaatcccagcactttgggaggccgaggcagacagattacaaggtcaggagttcgagatcagcctggccaacatagtgaaaccctgtctctactaaaaatacaaaaattacccaggcatggtggcacacgccggtaatcccagctactcgggagtctgaggcaggagaattgcttgaaacctaggaagaggaggttgcagtgagctgagctgtcccactgcactccagccttggagacagagcaaaactcagtctcaaaacaataaataaataaaataaaataaaataaaataaaataaaataaaataaaataaaataaaataaaataaataaaatagaaggatagagataaacatttcaagtaatgtgctgcatttgatatagcacccaaattttaaacaagttttctggtaataggactgtgttgtgtcttaaagtctatttatggtattttgaatgttgagtgcttctataatcacctagcattgggttatcccaccataattgtatttcctttacagaggtctattttgttgtaggtctgatagctccttgcttgtttaactactaacagcacaatggagatagaatttcacatggtgaagacaggaggataagatacaaagcactgtcaaccttttagatatgattggcttcaccagtaaattatcagcgaaggatggatttttcccccaagtacccactagacaatacatcttcccatgtgaacttaaaattacataaactcatggttagtctaaatatataatgaacggagatcacacaaccaaaacaaaaatcaaaatggaaaagattataaaatacgtagcaataaacctaatgagaaatgtgcagaccatataacaaggcttgaggaaaagaaaaattaagtacgtggttggagaaaattcaatattatacaaatgtttatttaccccaaattaatgacatttttggctgtcacaactgatagagcattaccggcatctaattagtagaggccagggatgctgctaaggatccctgctacaaagtacagggcagtccagtgtaaaatatcaatagcggagaggttgtgccctgaactgtctttaacagagaaaatcatgaatatagactctcttatgggtcaagtataatttgaaaacaaaggttcttggcccaaaggtttagattttcagtcaagatcttaaatttatttttactttcctataacattaaaggacagtttgagatttttgtgtttatcaaagaggaatgatagattagaaagtctgtgaaacattaggtggtgattaaagaattatggtgcttaaacctgggtagatgttaatggttcaataacatttttaagaaataagataattaagagagaagatttggcaaatgtgactgtatttacaaaagatccttgtagcttttggctacgtaacacaagcattcctttgttttattcattgtttgttccagatggatttactaaattgttcagagaaggggacccttattatttacctgtcttatagttgcatacagtaggaacataggaaaggaaccaatttagtaatgcatttggactcaaaagttaattctgcaattatactgggaaaaggaaggctaaaaaagacagaagctaggactgtaaatgattgtgggaccctgggtataaacttccatggataggatacaaagtcactgggatcaaacacatgcattggcagggcgtaagagttaagagagcatctgatttctaagatgaagactagtaatataaatagtcttctaatgttctaatctgaagtgggaaatatttatttgaatatataaattttgatatgttggccaattcaattactttgtagtcatgtctccttgatcatgtaatttcaaacatttttgtgtaaaaaatcattaagagcggtgttactccatataaactgttgtaaattatcagaagttagtggaggctgccatgaatagatttatattgtatgtaatggtctgattatgtttttttattatttctctagtaaacagagaaggtcaagtatttttaaaaatcacaaccctcaatagcatgtctatttcacactgcattttctggcctacaccaaactcacctaatttgcatattgagatataagtcaaatgtagttattcgaacctattatgtgtagggccatttggacaaccatacaaaaactttaagggaaaagtgtaccatagtcagatggcatccccatgactatgggaatattccaaaaaaaaatctatgggttgattaagtaaagatttactgggcaaaactgtacatgcatgccttaggagctagttaaggattttttgttaatatgaaggttggagcaaacaattcttaaattgacttatgattccaggtgtgaaagaccaattcctaactataagttctgtggtcttaagttacgtgccctatattagtttcctaggatttccataacaaagtgtcacagactggatggattgaacaacagaaatttattacctcacagttttgagggctagaagtctgaaatcaaagtgttggcacagttggttcttcctgagggagaatctgtgccacacctctctcccagtttctggtggtttactggcaagctttggtgttcctgggcttgaagactcaccctaatctctgccttcatgttcacctggtgttcttgctacagactgaatgtttgtctccccaaaatttctatgttgaaaccgaatccccaatgccatggtagtaagaggtggagggggccttcggaggtgattaggtgatgagaggagagccttcttaaattagattagtgcctttataatggagatcctggaagcctcctcctcccttctgtcatctgaggatacagtgagaaggcagtcatctatgaaccaggaagcaggttcttaccagaattcagccaagctggcacccttgtctcagacttccagaattataagaaataaatttctattgtttataaaaaccactatatttataataatattgttatagcagcttgaatggactaagacagttctacctgtgtgcaagcatctaaatttccccttttcataaagattagaggtcagattagagtcacattagaggtccaccctattctagcctgatctcatattaactaattgcatctgcatcgaccctgtttctaaataaagccgctttggaaggtactgggaattaggacttcaacccataatattccttatgtttagtttttttccaatactaggtttaattaatttaaatgattagggataattaattttatcatgagagaatacttatatgtgtggagagaaacagaaatgtttaaaaatgtggagaatgtaacaatacttccaggttctgaatactaattgcctccaaaaatctctacgaacattactatggagtctactcacttgaagcagctgaagtagatgatttgtctaaataaagtctatcattttcttgtgagtctaataagggaatacatatcacatagctgtttaatataacctggcattgaaaatgaggagaaagagaaagataagctaattgttgcagttgaaatgtactgatttgactatttcttaggagatactggaggatgaaatgcagaactttataagatgaggagaaatgattgcttatactgacttgaaaatagcatttagtttcatgttttgctgcatgagtataaacaccaattgtaaaatgcatttcatgcccagtatctgatttgtcaggaaagcaaataagatattgtttgtatctttacttacatgcataccatctttcagtgtttctcttttgtcttccttagtgggaaagccccctaaaacagatatttttcttgtaacattttataggtattgacttaaacaccattgatatctgaacatattgattatgtcactgaaaaaaatggctatcaagacatttagtgtttatatacctgatgttaaaatctttttaatgctgagttgattcgactagtgaccccaaccctaatacttcttgtaaccataaaaagcagtcttttaaaaattgtaatacctcatgaaacactagttttaatttacttccccttgaaagacctcgctgggaatatttgcattgtcagcagcttaaattgaccacagagataataactaaataatttagaaaaccgtaagatgatttaggcatttaagatgtgtataaggtaattaaaaccaaactttcggaggggtaagacctcactgtagttggttattctatagctggggtcactgcctaagttgtatgaaggcatatgttcaatttacagttgtaatgaggaacatggggtgttttgatccttcatttgttgtgctgatctctagaggatgcaattgcctgtattaaacaatgaacatggactcttttgtggcggataataaaaatgtgtaagataatacgtgccacgtgcatgtatgtttggcatgtggcttttctctgtttatggaattgttgccctttgttgctatcatggaacaggctcatggaaatgttcattattagccacttaggaacaagaccaattcgtttgacctcattagtttgatcatgattattccattttaactaatacatggtatttatgaaggtgttttccaaagattattcacttgcaagggcattttgtgttttattttactattctgcaaaaagacaaatagataaagtttaggtgataaagttttcttttgtcacatgttgaatgtagtaaaagacaaagcaggtttttttctgttttttttttattttacacttaaacaatgaatgacatcagggtttcagattttttctatatgtcgatacacttgaaaatactagcacatactcttgggataaactgaaagaaacatttataacatcatattgtgatacaggttgaagtaggaggaccagctttttattcagtgaaaacttgcattcatcccaatataaagtttgcaaaaccacagtgagcctagctatatccagggccctactcttggcttaaaacaaaacaatgcaaatgtaatctttcaatggtaaagaacatatgaaagagaatgatcttaaaacctctctaacttggacaaacaaacaggtgaagaataattggaattggtgggaaatataggaatagaaaatgtttttatgtcacagcttcatttaataagatgtagcaaacaaccatttggtttttgcacctgcagcactgctgtctccttggtgtactcttcttcactagttgcggttgtgtgggctgccaaaatcttcaccttgcctctctgtggtcatgtcactgaagattggtcaatcacaattcccaaatctcttatactgattggtctagaggttggtatgttatccaaacctggccaataagagttatatctaggatgtttacctttttggatcttgtagtaaaggagtttggggttttgggttttggagtaggaaagaagtagactagaagcaatctggcctaaccaaataaaaccaatgaagggtaacagaaaatgaatgtctgagaagaagcagatcttcgttacttcatttctaagtactcatagaactcagagttcctttttctcctgagcatccttcaaagatattcctcttcctttttatttttttttcagtttaagttggaaaagtcctgcttcatgaaataaacaagaactcttaatcaatatggtatctgtttgcatgtatatgtcctacttctaatgtactagacatcttctcttaaatattttaagctacatatataactttatttagacaaagtttggaccagctgaacccttcagtaatatgaaaaaggtaaattttacttcactgaataatcacaaaccttgaattggcagcatccaaattattagaactgtgcagcattaatgctgatctatgtaaattgggttcataaacttgcttgggccctggaagcaacttgcattattatgtattttttctctctaattttcaaatcaaattcattggtcattcatccccttgaaatcagattctgcagccacctggctttcctccaaaagtcttccattgtttcataagccatcctcgtttccaattcatttttctttatccactgtgtaaattaggtggacctgaatatttagaaaagattgaaagcatttggttgttattagagtaaagatagctaactcacacatgtgaaacattagagaaaacttacaaatgtttgagtaatttttttttctgttgttgttgtttggggctgtggggcatttaaccacatcctgccatgcacacacttgagcttctctctttattaccaggtagagtttctgactaataaaacaaacaaggacaatattttaattttcttttcccaacatttttattgtttttatttaaatgtaacatactatacactgttcagccttttgcgagttaggaggagggagtgattctatatctttatgaggagtattctcagaaccaaaactcaaatggacacatatttgtggctgatgcactttaactttgtgggcctgggaccatactcctacagaggcagatctctcaatagctccaatttttttttttttcaaatctacaacattcagggctgaaactgcttttttttttcttcagtagttgcaaaagggaccagaattctatttccatttcaagcaaatatgccacttttaaatgcaagagaatgtcattactccttaccaaacaatctttctttctctctccttccttccctcccttctttccttccttccttctttccttgcttccttccttccttccttccttccttccttccttccttccttccttcctgtctttctgtcttttctctctttcttttctcttttctctctttcctttctttctggctctttttcacccaggctggagtgcaatggcaagattatagctcactgcagcctcaaactcctgggcccaagagatccttccgtttcagcctcctgagtagttgggaccacaggtatatgccaccacgcatggctacatttgttttgttttgttttgtttaagagaaggatgtctcactaggtttctcaggcctgtctagaactcctggactcaagccatcttcccacagtctcccaaactgctgggattacaggtgtgagctactgcaccaggcaggttttttgtctttctgtgagggaaatgtgggagagacagggagatgttttctatttttggcctctgcaagctttaatatattttgctagaagctgttttagtgtcttgagtactataatgatgactgtttacacatagtctctttagtaatctaaatgtctatgtgaaataagaatccagtttgtgccctgtttgctgttactgtggtcatccaatgtgtatttgtcttaccaaacatttaattttggttgtgggtggtctatgtttatgtgtcaggtgcaattattattttaaaataaaggaaaaaaagatacctagttttgataggaatgcattacattatagctcacagactgagttaccaattaaattttaacatccagattccaaccacaaaaattaaacatttttataatctcatttgccaaaaagcaagttggaagcaaagtatgatgaaatgcaatttaaactataagccaaaagacagtgcctcaaatgtgtttcttctgaaatacagtttttttgaagaatgggaaaaatatgaccttttatgggattatacaaaaaatttcttaataaagcaatttttaaaaataacagattaactggaagtgctggttaagtattgacacaaataagtttgttggagaatcacagaacgccagcatttccaaaggttaaactttagtaagacacatttagtgagtctttttttttgtaccaaaatactgtgtccaaacaataaaatgctttttcaaaacaagaaatatgaagataaaactgcagcatcaatatactattatagttattgcttaaaagtatttagaacaaatagtatttttctacatttttaaaatcactacagacactgcaaataaggcttatgtatttatttagtggaatacaatgtgatgatgattggtaaactcttatgtactcttttctatacctgctctaacaaaatgaattttgatatggttacattatggaactttgtaaagctctttaaatttacagaaaacaagttttatttggttttgtaaagactagatcatacagctagaacaggtttttgtatatggttacacatataccagtatatatttgatttgctcagtttaagcccctgggagagttgcgcttcataccaaattctttgatagttcctttgggaaagatgcattatgtggaatttacagagggtttttagagatgtggacagcctctttaccgccatgacatttggcaagaaatcatgagtaaataatgaggctaggctatttaaatgtatttagcaattaattttcctttttttagtatattcttggaggcaaactgatgtattgaaagagaagaatttggccttctggtctatttcttgagacaggaagcctcgagagtaatatatgttttcaaatgatagcagacatctctcactcaagccatggcacagcattgccatatttattgttgatggttattactgcagaagtgcaaattaagtcaactgatagcacacgggcactcatactgcttccctaatcccaactcctatttttgaagtgttcgccaagttttaaaaacactttgtcgtgaacatgcatgtggtgtgctgaataaaaagaaaagataaatcagaagacagctgctgagatactctttaaaaccccaaaagatatttaacatcctattaaataaataacttagaaagaaatagaaagggatgaaggcagaatgcacaagcataccatactatttgtattgttagaacagtttcacactaacatgtttatatttttaaattctattcaattattccatgagaccacatccagaactcctttggttgtgcatatgatatgacccaagtgctttccagtaaatgcttgcatgtattactgttcattgattcattaggcttgaatgagcaatgaagtctttgatatgagttcgtattccataaataactttcccgaagatcgttctttcaacagattgttctatgtcctttaagttctatctcagaggtttaaaaacaaaaacttgacaacaacaacaaaaaacccagccacaatgtttttcacttgggaataacttctatcccattcgatctgcctatatcttgattataagacatgacacagaactaattaaaagaacatcatatgtcagcagtgaatacaaaaaccttcaaaggctggctttcttttaagcaagcagacatctgcaacgtgtctttgcctttcaatctactgtcttcatgaagaatatccactattcttggcaaaagagccattggttctactgcatccacaaacgttgccttcctctatgagtgtaccaccattggaagaaagtgagcagaggtgtttttccttcgtgttttctgtcctctccttggagctccttttccattcaatgccacatacatttgcctcccattatgctgccagttaaatgatgcataggtattgtatccattttcctctatcctctccttcagcttacagtcattgttaaattctttctgcaaaggaaaaacagaatcttttattcctatggtgattgtacttgatttcatttgatacaagccatccagagaactccagtccaaggattctgtttgtagttgccatttgtacctaagttgtgcacttaatacataatgtcaacaatagaaaagtaaatctcagaaccacaaaacacattctgtttgaaagcacatgatacattttaattgatcatcatagccactttttgaaagcccttttaaaaagctgatgtgctttgaatattatatggtttaagtgcctagagtgattgtcaagaagtagacatctcactaacaatatttgtgatgagtcagtaataaagaatagtgttataatgcttcttttacagtaataaccaggggccccatgggaaaaaatagaactgaaggaaagatatgggcttgtcaagtttgcaaactttacctacaaatccataataaatacacacacacattcataagaaagcagagcttatagcaaaaccacaatagttctgcataaccaaaagggggggatgtctttcttccaaatatcaaatttcttaatttaatgaaattatttgcaatattctatagcttggaattttgacagattttgctcgtgaactctagggattgaaaactaggacatggaattcctcgttttgtgaactactatgttgaagaaattatgagcatggtgaatagcaatgcctacattgtatcttaaggacttggatcctgggaagttccatcccatagccatagagctttggttttgttcaggaggccaattggatttaaggagacattcctggacaaggcttcgctctcactcactccacaaatccaggttcttactctggagttaataacaaagaggaagtagctcaatgatctcaagactctggctttagaagtagcctccgcagtgcctcacgcctgtaatcccagcactttgggaggctgaggcaggcgaatcacaaggtcaggagttcaagaccagcctggccaacatggtgaaaccccgtctatactaaaaatagaaaaaattagccaggcgtattggtgggcgcctgtaatctcagctactcggcaggctgaggcaggagagtagtttgaagctgggatgcggaggttgcagtgagccgagatcattccactgcactgcagcctgggcaacagaacgagactccgtctcaaaacaaaacaaaacaaaaacaaacagaaaaagagaagtagcttcttttcttatactcaaactaaagtagttaagaagctaaggaattggagcacttgccctctggttctatcttcttcatccaaagcaagggccccgtgggcatagttcagttgaggactgtacttggcagtttctctcaccttgagactttttgaaatttctacaaaattccaaattcctgaaaatgtatatgtttatatacctaggtgtctgtaggatttatcacagtttagaacattatcagaaccataagaagcagatgtattctatgttaatgctaccagctcaagttatctgtcctgaaattttttagtcttaaatgcttctcttctataaagtaatatttaaatataacattcaaatgatgatttaactggctgaaagtaagaaggaaaggtaaattatttaaggtaaggattttgataaaacaaaaataattctgtatttgaaaggaatataaatccttagtgtggatttacttttattctctttatctcagtctgtctaaaactatatacttttcaaagcagagtaatttttaaaatatggataattatgttcatttcaatcaataaatggggtacagtttagagactaatgaaggactgagattgtttgaggtgatttcatatttcagatgaagctaggtatacaaaagtgggagtgtatgcttaatgttaattttcctccccaaaattaatttatagagtaatgtttcttaaattgaagtgcacatgtatcagcctttttatttcagatgttttaaatatttgggccaaaggtaccaaatctctagaggaggggcctcaaaatatatgttgttgacaggatctaagcaaatcataagcagttatgtataaaaagaaaattcaggctacagcaaggactcaaaagcagggttcagggagtttttttaaaagaagtttggattttttccagctacctgaaaattttctttggtccttaaatcatgctctatgaagacctattctatttaattcagttttatactttatttactgaatcccatcagtcaggagaaaactcaaaatacaatagataaattgcttagagaatgaataatgaaaatataagaaaggtatacagtttccaaaaaggaatagaggaagataattcaagagaatagatataaaactggtttaatcagtcagtctgaatctttgcccaagtcagatttttaggagggcttacggaattgatggatactgtatgaaacaaaaaatgaaggtaggaattacaagagttgtcacctaatatacagaattatattagatatgcacttataaattttgatgttagttctattccactctgagcagaatattgaacttgaataaatttttcgtttaatttgaacaaaccataatttttcattattcctagtagaaatgtaaagttacacaaaaaagaatgttatggttagagaatgagtttctttctgagacaggctggaagtggaaagtatgttctgtaattggctgagcttctaccagaggttaggtttatgcagtgtataactgtgctctgtatggttctaagtgctgaacaaatagtgggggacaagactgacctcactctctccaaggtcacaatctattgggagaagacagtgaacaacaaacacattaatgagagaaatctcagataagtgccactgcagataatagaaagccaccggactctactttaaataaagaatttgaatgaaataattcacagagcttagagctcaagatgaagcataagcacagtccatgagctgtgttggggcagaagaaaaaaagaggagaaatgtgaagaaaagtattaaatatttttatgtcagagtttatttgaaagttatccatttctccttgatgtcatgtttttaaataagtatattttatcaattaaaagtatttaaaatcttttatattcattaaaattatttacattttcttccttaatctaaattagtgttagctggctttaggacgttgggtctagactaagtatgtgtgttgttatctcttcaaagaatatgtacctggttctcttccccaataattctgatatagtagatcaaggaagaacctggacatgtttaatgaaaacattaaacatgcctcaaaagagattatgatgtgaacccctaaatggaaccactttttataatggtctgttattcctctgggttcattaggggagcaatggtaatggagaaattttactaaaattcctctgacccccatgcaaaaaaaagcatttgccctagtcccagggaccaactcaaagcatgcctgactccccagttaaaagtggacctgatattagtaaaatacaaggctactctacatccagaccagcggttctcaaattgtggttactgcaccagcagcatcaggaacacctgggaccatgtgagaaatggaaattgaactgcaccacagacttattgaatcagaaaatatggctgtgggtcccattattctgtcttttaataagcccttccactgattctgatgcatactcaagtttaagagctgctggttctaaatggtcactaaatggttctaaatggttctctcagccttatgctaatcaacaaagtaagtttatttacaaatttaaagtgaaattcctttttgattacataaaaatgtaaaaatgacacaggatctgtttacaaaagtaaaaattatttaaaagatttgtgtcacaggttttatttctggccatatataatattacatgtcctccaaaaaattaaattaaaatttttccaagtttatagttgccttcaatacactccccttcagtagaatccagagaaaaaaatgaaattcagttagcatccccttgatctgtctctgggagggacacaataagatggatccacatgcacaaactaatatactcctgtcatcattcaaatgacagctaagagattgaaacctagttcccaactttattatagggctgctttgctatagctgatcctttcatacatgtaacaaccaatcatgctgtaattatttcatatttgttaacatttcccctaaatatattataaattatttgaagtcaaggcccatttctatacttctttcttatgcatctttgatatgtcaaacaatatctggcatatagtagatgttgatatgattgattgatgcatttttttctaaggacttgagcaggataaattgtctcactgcttgtaatttaattattattacaattgcaattataaaacaactatttggcattttaagtgagatcttaaatttctaagaaattggtttaaaagagtttgatccaagattgcagaagtggtattccaaatacttaacacctggtatggaatataggcatggatgtgcccaaagcactgcagggatacctgctccacaaggaccctattgcaaagaatatttcccacatatatatatatgattttgaggcataatttgaattaaaggttattgtctaggtaaataaaattctagagttgattgaacaacaagcaaaatggtgtttcttgacacatttccccatttcagattttaacaaaatgcaaaacatctgagcccttgtttcatcttcagccgtaacgcatatataatacatgggtttctactcaattcaagatctttgtttttagtgttttttctccaagttgtcttcattttccatgccaatctgaccggatgcttccgtgagagcctgacttggttagcagtttagaacattcacagacaaatgccagcagcagcctgtgtggtagactaatgggtgaacaacagaggagattacagaattggaagagctgctttgccagcccttgaaacagtggtgactaacccactgtggctctatttactagcaatagaaggataacaaagctattcggtgtctggaggaaactttccaaaactatggtaatggtttactggagtggatttgaaaacaaaagcagaatacttactgagccatagagtttccccttcttgttcatggctaagtaatagttgctgttaatggctttgacggcaacaactccgatttctactgatgttatctccaggatgcctaaaacatacaattttaaaaggctaaataaagaatcctaaatatatttggaagaaaagtaaaatcaaaagaaactattgagttgttttttgtgtggttctaaaaacaaaaggcacaaaacattggtaaacaaacaagcaaacaagcaaatctttttcaatgtgtcttaaaacccggcaagtatttccagcaaatatatagaaaaaagtaataaggctttaaaagaattccccttcattttactctgagcatacatagaaaatattgttttaattaaaatgcttcctttgctaactctgcattttcaaccctataaatattgaaacaactctactcatcttagcctagatttcaaaataacttatcagagcccatatctgtactatggtattaaattaaatctgtagcacatgtcaataatatgccagattacctcaatctctaaaaacagtgataaactatttcttcttgctaggatatagataatctaaatctcttggctacatttaactgatagattcatttttggcaaatgtgttgacattctgagatacagggagactaatcccaacatctgcactgtccctgaaatagcagaattactgctctgtgttgggggaaaatccataaacatggatttttaaggtttttttttttcctaggaaaaatggaaaatcgagggaagtagtaagaggtagacaagagctccttttccccttatacacaagtttcgattgctgcatctaaagataattttctcggaaaagtttgtagatcacaatagggaagtcagtttatcgtctactaaaagtgcccacccattttagtttaagaagacctagggaactaaaactacttatttcataactctcagcagtttgttcagggtagagaagtagcatcgtgattagcatgtggcctctggagccaaaatgtctgggttcaactcctggctctacatttattagtgaattaccataggagaagtcactgaagtgtcccatgactcaattttatttgcaaaatgggcaacataatagtacctccctcataattttgttgtgaatattaaatgagatagtacctataaaattattagaatttgcctggagcttagtatcttcttaattatcatcagagggtagtttttctccaacagtgctagattttggaaattcttcaatgggctatgtaaatcctgaacaatacatacaaattcccattggcttaatacatgaaatctgaaagttgagcatattatcatttgtcatgtatcatgagaaacaccatccccaatgcagtctacagattatatgttttcactcttcccatagagatagagtggcttagcttattctcgagagatgaataccttctttcctattccttcacaggttagccttatggaggccaatagaaatgcttgagtttcccctgttgccaagttgacataaccagagactttgccaagactacatgtcagagacccttctgtccatgtatctgtaggaagtctctgacctaacacagcactccttttcatcaaaagagatatatctcactctatttgcaagccaaaaccaaggaaagattgtgaaggatgaaggagacattatttgtgtttttttacatccatttcccttatgctggtagtttccctaaggtacacacacacacacacacacacgcacatttatttgcatattctgaaaaatattttcttaattcacacaatagccctctaaggatactgttgttagtctcgattacaaatataaaaacggaagatacttaggttatttaactcacacacacacaggtggtaaggtgataaaggtcggtaataatggatgttaacacttaagcctctgacttttagactctattgctccccatctctgactactttgcctctccatcacatcttcctcctctttcccattcctacaagggaaccctgttgcaaaccatctgacaaaatgactcatcaagataattttctttaatgacttaatgtgctgttcctcccaaggatgatggcatgccatagaggataacgtctgaatcttagagaacaaaatctaacatactttatttatgtcataagcagaagatacagagcagagcaggaggtagaattcaggggcaaaagattaggcagctgcttacattgtctggccaaaagacaagaaagtactgtcagtaaactgcaagatattctcttatgtatacttttgaaactgaaaattaatagaacaaagaggaatgaaggatgattttaagcaaaaaataaaccaatatttgtgaaggtgcatgcaacgtcctgggattaaactatactaacagactgagctatagtaatagtataagatacaactgaatttttgacccgttatttctgaggatgaactgcaagtggtattgtagattatatttagcttagatacccctttgtttctttctgctttacctgaaatgggagcacaatattcaaagactcaatcaaccattttttttccactttgcaactagtttaggcaagcttaaaaaggtttagctattatttttatattattatttagttattgtttcaaaatagagggaagacataggtgatttaatatcctttcgaattttgaaaataattttgggacgcagcgtatggtcaggtaagttataatttgatcatcttgtgagtaatggacaatgactgcacctattataaacatctgtgaatgtgaaaggggagttctgaaggactgaagcctagaggacttctttactttttgtaaggaatcactccagtttttctgttctttggtgaggatgatcaagtttgcctatcaaattatttttggaaaggagctccagaattttgtttgaggattgttggatcagtagcttatagttctatatgtgtatattttgaatcaaaactaaatgccagttaaaagagcctcctggaggaaagtgagttaagggcatactggatctccccgtgtttcttacaagtttatgactctacaattaccttaacattaaaagctataaaaaaaggtttttttttttttaactcaaagaaacacctgaaaattatattattaatgaaaggacacatgaattatatttcccattcatgtaaaacagatattttgtaaatttataggcatattcttgtagtgaaattctattatttatattaagttgtaactatattagtttttatgtcccttaaaacatgaatagcccaggtagtattgtgaatctatttaagggtctttggacaatttagttcaatcacttaggaagacctaggaggagaagggtacgcttttagaaaatgaaaatataaagtcaaatacgtaatggcttttctattgataagtctatgtactattgggaataaaagacaaacacagataattacaataaaacatgttacatggcagtaagtgatgacttaagatgatgacaaggggactatggggcaaaggtaaaggcaggtcatactggctggggttccacgatcaaattattgttggagatgagacctgaactgagtcatgaaggttaagaagtgtccaggggaaggctgggaagggtgggaaggcaagagcaaattattaaggtaaaacagtatggtgttttcaaatatcataagaggtttgatttaccaactggagtacaaggaacaagtcaggaagctgggaaaagtgaagttgggagataatgagactcagtttagtaaacatcttgtgcagattctaagaattttggcaactaggaaggattttgtctacaaatataaaattgtttaaagaatacattagaaataaagtaatatttagcaaatttcttcagtaaatagtagcaatctataaagcttattttagattatatttaaaatcttaaaaaataaagtttgatagtcaacattacaaaagcgattatgacaaaaatcagttcatattactttgcgaatgttccctcatgatgcatcatcaccttagtaatggagaaaattttgtgacttgataatctctgagtggaaataacttagaagtcacaattttcgtgtaaatgcatttttttcttttaatactcatatatataattgtttgggctggtaatgttttgatgagtgactaaatagttaatctgagaaggtggccattcacaagcatctttcccagctgctgcttctcattcttctccagaagaggagcatctgacctattgtccccctagcaatcatgttggacaaaggcttcttctgttttggtgctattagaatgaaaaagctattggtctggagggtaagtttctcactaaatatttttccataaacacaaaaggagaaagtatatggcaaataaaacttgtatttaatagaatggatatagacaaggaaaactagatgtgaaaaataagtgcaaaatccttctatccactcctagataaatagaacataaatatacaatggaattctatagactgagtaaattaattcagctaatgtgtattaagcaccagtgtgcagggtaggtgttagctctcattctgaaggttacaaaggcaaacaagatgtggtccttgcctcaaggagttttaaagctcaataaaataaagacccaaataagtaatgacaatacaaaaaaaaaaaaaaaccagaaagaaaatatattaagtgtggtatgagagataaaatatgttatacattactttaaatagtgaagccatcctgaagaagacagctggtgtttgaggtgacttttcaagagcagggttttaataggggggatttgggaagttgagaaggaacattccagggagagaaagtgcatgcataaaaacaggcttggagagagaaagagctcaagtgcttgagccacatttctccccacctcccccaatggcactttgaggtggccactagctaaaactaaaggttctgcttcattgagtggtagtggtgcttttctgggtgaggaatgtactttccaaaaaaaaattattgtgaaacgtggaaagtctcattaattcagaatcagtcacatctatttttctctaaacattttaacttgaaattgattataatgctatatagttttatagttttaatcaaggtgctgaaacatatcatagttagcacaatgtaagacacaaatactaacctctctaaatgaaacctctctctcccaagaattgttgtcagtgtcctaagttcatctattatatcctagcacagaaggacttagggagctccttggggttgttatcacattttcactaatacctctgggattatgtggccataccatagtgtgagtctaaatggctctaaatgtggttttacctctctttaaaaatgaaacaaagttaaatgaagtgaagcctcaaaacattatgggaactgtaatgtcccatggaccaatattggaactgggccacacagcgggaggcaagccataggcaagcgagagcgaggtttcaactgtatttagccactctccatcactagcattactgcctgagcactgcctcttatcagatcagtggcagcattagattctcacaggagtgcgaaccctactgtgaacaatgcaaggaagggatctaggttgcacactccatatgagaatctaactaatacctgataatctggggtggaacagtttcatctacaaaccatctcctcattccctttcgtgtaaaaaattgtcttccacgaaaccagtctctgctgccaaaaaggttggggaccgctggcctatagctcatagggttgcaaagaatctcagagagtgggtgctaaatatatatttactgtgtgctcaatcagaatagtggcaagttaaccaaccttctataccaatagttctcaaatatgaacgtgcatcagaatcatctggaagacttgcttaaagacagattgctgggatttttgacttagtaattctagattggagtagagaattagaattcctggcatatttccaaacagtgctgattctgcttttccaaggaccacacactgttctatacaatatgattcagagacaaagcacagctttgatgcaaaaaagcattgacagaacgtgtgcatagaagcagaaccacagacaggaatacacacaagtaatagcggcagcttaacaacaagaaaaattttaaacaatgtggaaaattagtaacctcatttttgaacaggtatgggatttttaacatctacataactatggtattgtgaatttgggatttgtgtacagatatactgcattgttgttgatagtcatcagaatctttattttcttctccattttaaaagtgtggaaatgttggtggaaacttaagtgccttcaactactcataagaattttatgggctttttcaaagggctaactgtgttaacaccaagaattaaaggactatatggcccccttaaatatatgcacatggtcaagaaattgtctcaaagcaatagggctccactttatccttcaccctacacccagtgttgaaagcatgtattaatacttgctctagaatgatctcattgccattaaaaggagggtactagactgggctaatcagtaatctatgtctagtccacctcctaccattatacactctggttgcctttttagtataatgtatttgagttatttagtttctctatcttccacagttctgtcaatacgcttgacatgcatttggaattacagatagaaatgagatctgaatttgcagaaaatcctttctatctctggataagatgatatatctttcacagtatgctaaataccaaaatgacattttacattctcacctgataattcaagtcataggataaatacagtgcctagcttagccttattgatgagtacagtggcagatcccaaaacacttgtcaatttaagactatatttaaccaatattgtcattcagccattgtcattgatctaacattaaaagtatcagaaacttacaatgcaatatagggacaatattcttaagtggtaaattaattgttaaagtgtgttaaagatcaatttcttactgcatttttattacaaatgaaatatgactccagatctttcacagtgatcataagtgaacaaatatttgcagatgaccatctaataggtttcttcacaacactgtgctagatcaatagatttggtaaacttgactttttttttctaattttttcctcactggtagagattttttaaatgtatttaacattatggaaatatttcaggaaataattacttatcaatattgtaataatgtcatgttttcaaacattatcctctctgttcttaggatacattcacagtgagacacaaatgacacgtgtctaggacagaaatggatttgtaattcttgagaactgttcataataagtgctgatataaattgaattcacaaagtgtgaaatgattctatcgctagttttgggtaaaataaagatctagaaaagcttgtgttcccctggagatagaaactctacccttattcccaactaccagcaatccagcaaacaaacaaaaaaacaacaactactggaaacacttacatgtttgagtcatttgctgtgacccaagataactgacttttgatcccattttgcaatgggataaattgcgggaaatggtacaagacagaaaagttaagaaaagaagcctgaacgattacgttagaaaagtcctgcacaattcatttgaatggtaacaaagccatgagcaaggcagagagtaattcttcccgataggtaaacatttctgtatcagaaaacatatttctatataaagttttatgtagcaatttattggtttttctttcccctcatttcctttagtagataactcaacccttcaaaaattctgaaaagttcgaaatcctggctttttgccagagcatcatggccacatcccacttttgtctctattcttatctaatgcatttcatattttaaggaaaatcccaagggaatctttgtgtggtttgtgtcttctcgcgagcattggaaggacagaaagtctgccagtctgtacagaaagtttcatatactgaccatgcaaaaataaggcacaatcattgcaatgttatcacttctgggaaaatatatccagaatgcaaaataatgttagaaacatgttatgcatcagtagaagccaacttactacctagattagatctattatgatacagaagctttggcaagcatgtcaactgtcatatttttccccaaagtactaagttattttacattattttgagatatcttctatgttcaatcaaaacctctgatcaatctaatttgagctaaaattactaaatttaaaaaatacttgttattttagtgagaaaagttcagatcatttaaggcttggtcttagcaaattgtagagtcagagaagatttcgaagaaatctagatattgtctgtttcatatccaattctctttcgtaatagatgacattgggaaatccagagagattgagggacttacctgtaaaggttacttagagccttaagtaaatacttagtctacctcaccatgaggctcctgctaacatttacaaacagttggcagccaggcaaagattttatatcttgttcattacacagaaacaattcattctatttgggcttggccactgcattttatttataaagagagaaaaaaaattaagccacataaagggttagaggagttactgcatggcatattttaataaatgatcaacatgttaatatagacatttaccctaaagacattgctataaactgtctaccacatttactcaggtttttatgaatttctttaatataactaattataatatagagtatcttttctcctcaatttaaggaaaataataaaatgggtcagtagagcacatcttgatattgggtttcctgtaagaaaaagtcttacttgatgcattaaagtgttcacaaatttgctaatcatgaacagccctgagtagttttaaatacttaatatggaataagtttgaggggttcaagctgtaggctcactttgaacatgtgtattgtaaatttgacaagcttccaacatggtatagaataatacataattggcctcttaattccttcaaagattatttccatgattacttagtgggtaatcataatacttataagaaatatatattccactgtgtggtatgtgaattttgatttgattgtgcagaaagacaatttatctatttatgtatacttgacaaatggcaacattgattcatttgccataactatatatttatgtaactcaggggcctccaaccactgggccatggactggtactggtccatggcctggtaggaaccaggctgcacagcaggaagtggccggtggtgagtgagtgaagctccatctgtatttgcagccactccacagctactgcccatcagtcgttactgcctgatctctgcctcccatcagatcagcagcagcattagattctcataggagctcgaacactattgtgaactgcatatgtgagggactgggttgcatgcttcttatgacaatctaatgcctgatgatctgaggtgaagctgaggtggtgatgctagcactgaggagcagatgcaaatatagatgaacgttagcagacagatttgactgcacagagaccatcataaatcagttgcttacagactcatatcaaaaccctatctgtgctgcatctggtgtcaggctttaagtcagaatctagcacttaatttagtccatgtatggcccatccattattgtatttaccacttccacccatgcttctttcctgcactgtgcacttgtttcagtcacagttttggtaagccctcaagctaacccagccaaaatgagtaaaaaacaaacatcactggagtgcttctttgaaggagggaaagacccagtgatgcaacagcggaagacttctaagactgcctacaaaaattcagcatttaaaagaaaataacaagagtcccacttaaattatgggttcactgcaacaggtgattcacattcattctgcaagcctgctttgtataatatgtgatgactggctatccaaaaaagccataaaacctttaaaacttcttcaccacatgcagattaagcaccctgtgtcaaaagtcaagttcaagtctttggaggttttctttttttttctttttctctactttttttttctttttgaggtagggtctcactctgtcacccaggctggagtgcagtggcacaacctctgcctcccggactcaagtgatccttccatctcagtatccctagtagctggaaccacaggcatgtgccgccatgcctgatttttgtattttttgtatatatggggtttcaccatgttgctcaggctggtctcaaactcctggcctcaagcaatccacccacctaggcctcccaaagtgccagtccattttgaagtttttcaaaagaaaaaaaaaaagatgaacatgaagaacagaagcaaacattgaaggacaccacttcatcaaatgtgtctaaactgagagcatcattcttagtggctaaccacattgctacagctaagagaccctttactattggtgaagagttgatccttcctgctgctaaggacatttgtcatgaacttacagaagaggctgcagttcaaaagttggcacatgttcctctttcagctagcaccataactagaccaattgatgaaatagcaggggatatcagggcacaattgttagagaggactaatgagtcaccatggtatgtagtctaggttgatgtgtctattgatgttgacaaggcaacaatgcttgttttagtgcaatatatttttcaggaggatgtgcatgaggatttgttatgtgcacttttgttggcaatcaacaccacagctgcataaacattcaagtctttgaatgaatatatatcaagaaaactgaattggtcattttgtgtcagtatatgcatagacagagtagctgccgtgactaaaatggctttctgatttcactgctcgggtcaaagaggtcgcttctgaatgtgagtctatgcactgtgtcatctacagagaaatgctggctagccaaaaaatgtcacttgaacttaacaacattttgcaggatgtgattaaaattatcaaccacattaaagtacatgctcttaactcatgtctgtttgcacagttctgtgaggagacagacagagagcacacacatcttctcttttttttgagacagaatctcactctgttgcccaggccagagtgcagtggcacgatctcagttcaccacaacctctgcctcctgggttccagtgattctcctgcctcagcctcccaagtagctgagattatagggtgcccatcaccatgcccggctaatttttgtggttttagtagagacagggtttctccatgttggccaggctggcattgaactcctgacctcaagtgatctgcccgccttagcctcccaaagtgctgggattacaggtgtgagccactgcgcccagctacatcttcccttatacacagaagtgagatggctttttaaaggtagatccctggccagagtttttgagttatgagaactactccagagatttttagaacaacaatcaccactggcagcacatttcagtgacacagaatgggtcccaaaacttgcctatttgtgtgacatattcaacctagtcaacaaactcaatctgtcacttcaggggagaatgagaactgtgttcaagtcagcaaaagggtctgcattaaaagccaaagtagaattatgggggtgatgagtgaacattgggatttctgatatgttttaaacattagctgtgatttataaagaggctgagccagggccttctttctcacagctggtacatgatcacttacctcagctttcaaaagcatttgagtattactcaaaagaccccaaactgggaagaaatggatccatgacccatttatgaataagccaggtgaatggactttgtccatgttagaaaaggatcaactgcttgagatcacaaatgacagtggactttaaaatatatttgagacaacttcaaatctccatatgttctggattaaagtcaaggcagaatatcttgtaattgccacaaaagcaccaaagagcctgcttcaatttccaacattctatctttgtgaagcagggttttctgcagtgacagcaaccaaaatgagattatggagtagatgggactatctagttgcaggaaaacaagctcagggctcccactgattctacattatggtgagttgtataattatgttattatatattacaatgtaataataataatagaaataaagtacgcaataaaagtaatgtgactgaatccccctgacaccatctccttcaccggtccatggaaacattgtcttccacaaaatcagtccctggtgccaaaaaagttggggaacactgctataacttataatattggcaataaagatttttggcttctgctgtaaaggagatgtttaatcaatatgttttggaaggtcctggctttctggactacagatcaccccctttgggatgattaccaagactgaagtggttctttatccctaaagtccatggaaatgtcctatttttgccacaactcacacttggcaaagaaagaaaacagaacccataggttggaaatacaagaagagagcatcacacatcatttctgactactaaatacaatgtgactactagtaaagcatgcagccagtattttgtaggaaatgttagagaaagtactttcatagaaattagtttaaagggttttcctggtgcttaaaaattgtattttaagaaagtaattaaacaaatattagaactcagcatgaaaatctgacattatagtacagataacatgggaaaagcaacactgggctagagatggtctaagaacaggtactattaccttaaccacatgtggggagggagcattactcattctttagtaagatgcaactaaggattgatattagaatccaacatatatgcattattgttttttgtaattaaatgtgggaaatggattgttaggtaagatgtttttctaaagctcatgaaacacttttattaagtcttgagttaacaaactatctataaagaaattcctagagaggatgagtgcaatctggcacattatgatctgtttcctcttgatagaaaagaccagaaattatcccattatcctgttttactttttaaaaatgcttacattgttttaaagtagtatgttcttgagaaagtgctcatgccctttaagaaaaaacatgatctatctgatccaatttgaaaatgaaaactgatgggtaagggacacattttatgtgggaattggtgctacaaaatcaacaggaaacattaagagagttttaaaaatgcaaagagaatagtaagtggataaaaataatgtatatccctatctatctacctatctatctacacacaaacaagtgttatttcatactcctcttggtgtcttagtaaatgattctaaatggaatatgttgaaatttcattatttaagaatagatgatagattaaaactactatgtacttgagttctcatgcacataaaatattgctgggatccagattaaaggacaagggacataaagggaaaggcaaaagctaaaagttaaaagagaagaaacactgaaaaaaaagaaaattattgaactgacttgactttgtatatattacattattaaatgcattattaaaatatatatccaagccatgttaactgtaaatgtctaactttcctcgtcaaattttatctgaaactgtcaaaacttttaaaacttagaagaagaatattgagaaaaacattaccttaaacttctttttaacgtacctgggttcagctagataaaaccgcacaatatcatatcttgaagaaatgtttttatttacatttattcgtcaaaatctgaaggcattccttccagaagaaagactctcttaatattatttattgcatataatgaattgtaagaaggactttaaattgattttctcaaatctgactagcttataaagtgttgtcagataattattaaattcaactgaaataaaataatttataataatgcatgatgattaaaatgttggtacataaatatgagacagggaaaaacaaaggctggaaaagactggacaaatttgaaaacaacttttcaacttgccaccaaaatggcaaaacctaattctaggtaaagtggttgactttttcaagtcagattaataaattaatgtaaacatctataaggaataagcaacatccaacagtttcatactattcaatttcttttgcaaatgtttcctctttttttgctaattcttaaagatcaggaaaaaaactgtgtgtaacataatttcaatgtagattattccttggtaaaattcaaagtaaaccctgtttatttgtttttatataaggatcttataaatgatatccaaatagacatcaaatttagtgtcataataagtgggcgaaggatatgagcagacacaaaagaaggcatttatgcagccaaaagacacatgaaaaaatgctcatcatcactggccatcagagaaatgcaaatcaaaaccacagtgagataccatctcacacgagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggattatcaatcatgctgctataaagacacatgcacacgtatgtttattgcggcactattcacaatagcaaagacttggaaccaacgcaaatgtccaacaatgatagactggattaaaaaaatgtggcacatatacaccatggaatactatgcagccatcaaaaatgatgagttcatgtcctttgtagggacatggatgaagctggaaaccatcattctcagcaaactatcacaaggacaaaaaaccaaacactgcatgttctcactcataggtgggaattgaacaatgagaacatttggacacaggaagggaacatcacacaccagggcctggggaggggggagggatagcattaggacatatacctaatgtaaatgacgagttaatgggtgcagcacaccaacatggcacatgtatacatatgttacaaacctgcacgttgtgcacatgtaccctaaaacttaaagtataatacaaaattttaaaaaaaagaaaagatatatttgaagtctctatatttcaacaaaatagactcaaattcagtacccatcatacagcatatatttcacagtcactattattcaataggtatgtatatgaatagatacacatctatcttatacaaaaacaggtcaaaaagcatttaaaaataaaaataaaacttaaccaaaacagaaataaataaaaatagacatgcccttaaaaagcttgagaaacttaattaaactctggcaaaccatggaaatggaactcaggaatagaactctattaagcaatttttccttatgtatagattatagctactgtgtagctgagcctatttcttaatgcactgatacaagaactaggtatcttttagtttagaggagaaatgtttagtgtgcagatttcaaactctttcaacattctgatctctgatcatgtagtacaattgagaagtatgatgaagaggatggcatatttagcttgaagttaaaagagatccaacttgcccttagtttattacgtatttattgttgagacagggtctcactctgtcacccatgctggagtgcagttccatgatcatggctcattacagcttcaacctcccaggctcaagcgatcctcccaactctgcctcccaagtagctgggactacaggcacaaaccaccatgcccagctaatttttttttttttaatattgtttgtagagacagaggtctcactatgttgcctaagctgttctcaatctcccaggatcaagcaatcctcccatctcagcctcccaaagtgttgagaccacccttagtttattgaaagcatacttctttcttcatatggacctcatctgcctctcttacctgatgctgtactaccagcaccgggatcatatttcatatgtatatatgtaaacaaattaataaatttatctgaagaaactcatgtgaaaagtacttgtttcaacttggcaaactcattttttcctagaaaaaggaaagaagaaagaagtgctcggtgttctttctgttcaattctcaagttgaaaggggacactacaggaaaagggaagctgttcctctgttggcaggtattccctatttaattgtgtctcaactctgcccagggtactcagtggggtaaaatcagaagcccttccagggtaggcaggactatagagcagcactccccacccactgccccaagttttcttcagtcttcagcgtggtttccagcctgaggctgaatcctcccattatttaacatatgcatattcaactcaaaataataaacgtgtaccatgagggactgactgctaaatgtatccctgtgaaaaatcacactgacaatatttgatgtttactgggtataaaagccatctacgaaacataagaaggatttcttgtgacttgtatgctataggaagagaactaataaaagagtcccaagcctaaaccagaattattctgctcagtctttttcttctaaattcacttgcttcaaccacaacaaaagccaaggaccactttggctcccttttcttacccaagtttgcagtcataataaccttttaaaaaaggtttttaaaaagagtcccttaaccacaaagtccaatatctcagtccacaccctggatattctttgtctcacaaacttggtcaaggatgttaaggtaataaggtccactgcaaacatccaaatataaacaactgcttgttgattctaaaatcctgatgagtgttttcatcttgagtgtttaacagctttctgacatggtaggatatcctatctttcttcctctagacaacaaacagctttctcatccctctttgccttctcagtcattcaacactttagctaaagggaggagcacaaattcttttctgtatgtggagacttaaagactactaggaagcacacaaccatttcacacccttcctctttcatcatcaccagctcctctttttattgtttctccaacttgcctgttgacaaagacagctgctaacaattgcatttgtggtactaggatatgcagtctaattgcataggcttgtggccaggggtcttgtccagttaagattgattttcaaaaggagagctacagagacatttccttagatgtcttcccactcacaaagttcaagggacattcatactatactcttaaatggctgcacttgaaaattgttttcatgttttgttttgtttttttcctttcacctttatgtaacccctccaaaaatcctggcatagatgttgagtgaagagagtactgctcattagaatcaacagttttcttttgttcagttgcccttgctggctaactactaaacaacgtaatcgcattggaaagtcagagatatttttgcctttgaaactgaagcaaaatggtgacacaaattctttaggtagcaaatttgctggcaaatttattacagacataaaaacatataaccagttgttttctttacaagatacttatttatcagattctgtacatttcccttaacccttacaattatcttatctatgagatcttaacccatactgacaatctcatgtatattcctaaaatacttttaaaaagtctaatggtcgggcatggtggctcactcttgtaatcccagcactttgggaagccaatgcaggaggattgcttgagcctaggaatttgagagcagcctgggcaccatagtgagaccgcgtcactacaaaacacacacagaaaaattagctgggcatggtgatgcatgcctgtggtcccagatgctcagaaggctgaggtaggaaaatcacttgagccaaggaggtagaggctgcagtgagctgtgattgcattactgcactccatctgagtgtcttttgcagcaacgtggatggaacaggaagctgttattttaagtgaaacaagtcagacacaaaaagacaaatatgtattctcactgataagtggagaggatacaaaattatctgggtatggcagcgcacacctgtagttgcagctactgaggaagctgagttgggaggatgtttgagcccaggagtttgaagctgcagtgagccacgattgcaccattacaatccagcctaggtgacagagtgagactctgtctctgaataaataaatagcctaagaagaggaaaaccttataagaaaaattatttcaagtggattccaacccagaataactagttgacgtatttgaagaattaataatgtagattgtgctcttactgttagtaaataggtgcatttcattgattccttttggttttaccaagtacagtcttttgttttgttttgaagtggagtctcactctgtctcccaggctggcctggctggagtgcgctagtgcaatctcagatcactgcaacctctgcctcccgagttcaagtgattcttctgcctcagcctcctgagtagctgggattacaggtgcatgccaccacacctggctaatttttgtatttttagtagacgcggggtttcaccatgtttgtcaggctggtctcaaacttctgacctcttgatcctcccgcctcggcaccccaaagtgctgggattacaggtgtgagccaccgtgcctggcctagtcttttctatatttgtagaagtagatctttctcattggctggcatagattggtgatagtttcttaacttggcatcactatctgctatttcatcaacacctccaacctaaactagaacgcatattcacatgaaaatttaaatgaaaaaaaatcacaaaaatgagcatgtacccaatataagaaacatttgctttgaaattgatggcttggaccttttaagtggttttggcaaaattaccatctggtctccaacacaaaacagctgttttaggtggcaaaatcttgtcaagctaaagctcccaacccttaagcacgggtaattggcaagaccttgttccagttcatctttagtccctactgaatctgggcaaacaactgtgaatttgcgctaaattcctcttcctataataggcagcctggcttcccatggagacacagagttttcagagccttagtgtcctcagggtatctgccagtacaaagctggtctaggataagccacattaatagcagtttcctcttttcattcataagctgtccttttatatttatgagctcattcttgtgagttaaatattttggatgtatttctgcaactttagtatttacccaatacttactcaaaaacagtaagttgtctaatcctttagtagtttttcaacattttcaaaagtattgcattttcaaaagaaagttaaaggagcattataaacaaggtgcaaggagacagtggcagttgagacttcgctttctcaacatatggcttatgttacaactgagcaagcccccagcttttatctctgggagctgtgaagttgactgcttataaggtctcaatgtctaattaatccttacttaaaattcacctaagtaagtataacagggataggaagttggtttctgttagcagttccacctttcaccctaccaaacatctgggaaatattcagtttaagatcagatccaagccttttggcattaactaccttaaaacattaagatatcaccagcaatttgcctctgtttcagaaaattaaaagcatatttgagatataaacatgagtgtgtcactaatattactggcaataattgagagctattcttttattataatgaggggaaaacagaggatattctcagatgaaataggtagagtaagtccaaatggtaacattactttcctaaaataactgtgtatgtaatgaatgctgaaggtaaagcatattaaatgctagtgttttctttcatggctgttgcactatttgttaggatagagagcatacatagcttatgtaagcaatataaagcctcatctgtctcttagaaaaatgtcaaaattacaatttaaactgttcaaaatataaactaagaattatcaacttcattgatcagacgtcattttttgtgagattattgactgtttgcttaaaattaaaaaaatggacgttttcttcagactttgtctcacaaacagtaatttgcattcatattcttaataattaatggtgagatcatggggaaaagacatcataagtaatgattcctggtaaaattatgatggttatgacttcatttatatactaaagctaatggtaaaaggagagagagacaaatgagaagtgcttttctgtggtttgaagacatagttctgaaaaatttctttgggagctaaatttaaatttctgacaagcctcttccttttgtccagatacaaattaagccagactagatagtgcttaaaatttttgtgcacttattttaggagctccttttttctggggccactccaccaagactttgcttattacatttttcactttggagctttgcttaacaattcagtctctttcttagaaactgtttgtaaacatctatcagtatccaaattcttacatccataaacttcatgtgattttaggctttattaaataattccattgataataagagaaagaggaaaaggaaactggaaatgtgactgtgcctttaattggagattgcaaaatttttctcaagcaattttcatgtttgattcaatgttttctaaaaaagcattgacatttaaaacattctttaaaaggtcattttaaagacatgtgagcaagttgtactgagggtgttgtatgtgcaattagggttctttcctctgtaaagccttgccaattccttagatgaatgagaatccatcagctcagttttcatcaccttttgtgtctctgagtctgacacaatgttgttgatcccattttgcatgcaaaatacatgtgggattgaaaattaaaagcagttaccagccggctgttaataacacataaccaaagatcatcgagagcagaaatcatgctagcatcatgctaaaaagaatgtctaacagtgccatgaatattgtggttactcaatacttagtgattggttgatatttaatgtggacacttttgggcttgagatggagacatgcaagctgtgttctgatggcagtgcagcagaatataaataacttgaagggaaaaaaaaaacctaccaattcctccctatctccccacctcttcagaaacaacgaatactattaaacccaatagatgtgtaaagcacaagtatgaaccccagttttccatttaaataatacaaagaggtgtttagcatcgtgttaaagtctctctctctctcttaatctttgggtagggattttgttggtagaagttccagctttggattggcaagttggaagctgtatgaatttgaaacagccagttaatgtctaggagtttccttcctcatctgtaaaataagttggttgccccagtgagtatcaaagacttttccagctttataattctatgatctatgaacaagagccaaaatcacaatttaggatttggcacctgattttatactatgctagtgccatggaactgcttatttcattaatctcacatgttgaatttctctatgtaacctggtttgactttgttgttttttcctttaaaggaaccaagcatactatccatttggcaactgagagtggttcttaaaagagcttttaattgggaaataaatgcaatgccagtggtacatatgtcctactgccctctagtggataaaaccatatcttccctagagtagttaacaagtttggttaaaatagcgcttctcaagctatacacatcacctggggtgacgccttagcttctgcattacaaactcccaggtgatttcagtgctgctggtcctaggaccacactttgagtagcatgagtttaagtgattttctttggtatataattactttaagtaaggaaggaaacatatttggcacaggatatgaaagaagtttctagttagcagaagatgcagaggaagaaaaagaaacagaaggaggggaaggaggaggaggagagaaaagggcaagagaatgagaaggagacggggaagaatatgaagaaggaattaaatccaccagattgaaagggctcatgtggcaaaactacatagttcttgatcactagcaatctctagaaagtttctatatctaggcttaataggacagtatatgcattaggacttacattgtgttcctcttatcttttattatattttagtaaattttaattaaaaagaagtcctgaccccccccaaaaaaattacaacttcttgaatcaaagttaagattttacaattctataattatgtaaacatacatattaaaatcagtctagagagaaaatactcactacttttgtgtattttattacagaagtaagctgtgttggtggaacactgagtatatatagctagatgcacttaactcttgcatagtgagatttcttcccagacagtagaatagtcaaagtttagcaacaaaaacctgtatgttcaaagcactgttctgagtactgagaatatagacctaagcaaggaagccaacccagcagtggcattttgtcatgagttaattccagagaagaagagaataaacaactatgttaaagtataacaaaatttatagaagattaatagtcatcccatttatggagcatcactatgtccttgaccctatgctaagcaaacatcggccattattttgatggccccattatattctccattatatacataaggaagctgaaactaaaagaggttaaagtcaaggtccaaactcatgtatgacatcaaaccttaaccactggattgtgttgcatttcattgattttcaaaatgttaactccagctaatcaacagatgaaggggaatccttcccctctgtgttccatattttcaacagctgcctctttagtgcaatggaaggagataatgtgaggctgccagtttgagtaataaataatgtgtgttggtgtctcagcatctcttcatttttattcgatctgtgaggagcgtggctgtaggaagaggcagcgggagggaaagcagaacctgagacttgtatctctgttttaagtttggttccctactctaccccttcagcgtagctttcatcctcttcagtagattaaatcttctggcccacaccctctttattttcagaaacaaatggtcacgtggggcaaaaggtgattctcttttgctgctacaactaggaggggcatcatttccttataataatggtaaatattacttcaaatttaccttcccagttttccacttccaggcaagcatcagttacttgtcttgaaactttgttatgccccatttttttattttgaatgaggatatagtgccctatccttatgtccacaaccttaggccttgtatccgttcctgttttgccatatcatctctgtactccagagtaagaatccattttaaaatactgcttcttctcattctttcatagaatattctaagtttgtttctggaatagtctcaggcattgtctacaaagaaatcttgaaatccaaaaccaacataaaggctctcccaggtcacttaaaaaaagaaatgtaagccaccttcttatcccaactacataggggaatatggttacttcccacagggaaattttttttttattatactttaagttctagggcacatgtgcacaacgttagaagcttaccaatggaaatgtctttagaggtcatattaaagaatgtcagtaatttggattggacacaataaatgtcctaatggttgaatgaattacctagcttaacacaactggtggttaagccagctgaaattcaaactcatgtttttttcaatatcagccaaatgctcttttcactagctctaaaaaaatgatactattgcagagtagttaccacctgatatggtaatgcctagcgaaagctggtgcctgacattgtttagtcagctgacaaataaagatacttgcataaacaagcccaggaaaggctcagtggaaattgatcatgaatgttgggagaaaatcatgagtaagcataagataaatccctgtatcacagaagaacttttccctttctttgtctcccttaatcattctcacttgaacattttcccctactaatgttaggattttaaaaagatataatattgtatttgatttaatttaatcttttccaagtacttccagactcaaaatttaacttcatcatgaaagagtgataaataacagcaagacaggaacatataaatctgaatagtctttttctaatcatcagttataaatgaaatttggttttcaaactaggcttacaggtaggaatatgtggctcataacataacaataatcactcataacaatgatcactcaccaagaggcattcatgcatcttttcttaatggtgagaagaaatgacctactctcccttcccttccctcaagcatgcccaagtagactggagatcttcagattttcctttttgtatcaagttaaactctagtggctgtattttccattctatttatagctagtgttctacttagtatgtatcttagtataaaacaaaaaacatactttcatattaagggtactaaacaaaagttctcttgggaattctactggtaacaatcattcagattttatgttcccaattctatgtgacaaatataatgtttggcatgttaaacatattcattgatttacaacctgagtgttattaagaaaggccaattacattctatttatttaggttaaattattttttagcacatggaagctaattatggaaaacacatcctttgtaccaattcatacaggagtcaagccatgattagagttgcctgtctagctttaatatactgctttccactttattgactatacagattgggaaagtacatattgaaaatgaaagacaatctgtaaacaaatgttatagaatatgctactttacctaggcatacccattttagtaactcatataaacattcatattattgaatatttaaaatatcagaatataattggtaaatattaataacagtaataacttcaacagaggtctaacaaataggacaattctatggattcaaatgtttgaccaactagaaagtaaaagggaagaaaactgaaataagataacataaaatatgtaccatttgaatcacaaatttgtagatgaataaggtagaattgttttatctttatcattgtatattaatgaacttgcatgtttttcatcatattttaaaaccaaattttcatcagtatttcattaatgtttttggagagctgtgctttttataactgctaatttttaagttctttgtaagtttgattctctttctttttttctaattcattttatctctttaatgagagttactcaaaatatataatttttgtctgaaaatgatttaaatagtctaagaaatactggtgtttttcaaaatttctttcatggtatttaaatgcataattttgtgctagtttatatattttattctcgtctttttgtggtttgatttcataatattcagagataatcagtttcaaatacttactgtgatcaaaattactgattgtcagattctatgtttgtcttctttgttttgttgtaatcatatcacttcatttccccacaccctcctcctccggggagaggtggagaagaactgtctcatggaaagatttctctaatgagtaccctaagtgacagaaagaccatatagagcaatgcttatacatttggactttggaaagctggagttcaaatcctgggtccacaaattatttaagcttgctaagcccagttttttcatctgtaatatgaaataaaaatagaatttagaactgtggtaagaattaaatgagatgatgccttaaaagtatatagaagaatgataaaagaatatggtaaaatgacagttacttttattaatctccttgttttgcatatttcagaagtcagcaacttttcatcttagttacgttccatctaaggtgaaatctagatagaggaagtgacatggaagacaaagagcgcttactaaccaatttggggaagtggcaaggcagaatggtaaacctgaaaataaccaaagatgagcctcaaattttcttagatcctatattccctgacagctgactcaaactgagaaagaggctatcttaaataagatagagtaccactatttctgccactactattataacaaattttaatcccaaaaataggctttaacatctagtggtttcacctgtgaatgttattacattttttttctaaaataggtaagcttatgttatattagtgatcccaatttattttgcaaaaaagtagcataactctgatactgaaatattaagataacacaaaaagaaagatactattgaatcctagataaaacattaattaattgaattccacagtctattatagaagatctcattatgatcaattgaggcatatcccaggaattcaaatgaagttcactcttagtaaactacaccgactgacgcaactagtatttaacattaactcactagtccaggttaatgcaatgtaacattaaacaaaaattagaaagataagtattaaaaagaggaaaccataccatcattaccttttgatgatagaactgcctagctaaaacacaaaaataatctactgaaaacatttatttcagtttgttgaattaaaagtactttaaatcaacatttttctatgcgtgaagcactattagaaaataaaatggtcagagatgccaaaaacagatttggacattaaaaagcatattagggcccagcgtggtggctcacgcctgtaatcccagcactttgggaggctgagacaggtggatcacgaggtcaggagatcgagaccatcctggctaacacagtgaaaacccgtctctactaaaaatacaaaaaattagccaggcgtagtggcatgcgcctgtagtcccagctacatgggaggctgacgcaggagaatcacttgaacccgggaggtggaggttgcagtgagttgaattgtgccactgcactccagcctgggcgacacagcgagactctgtctcagaaaaaaaaatgcatattacaattattatgtgtaatgatgacaaagtgaaaacaatctaaatgtccaaataaatgtatgtattaaataaattattattctaacatgtaattattatgtttccaccaacaatcatataacatgttagaaaaaggttaaaaatagcattaatgagttgaggaattgctaataatgtaagctttaaatttgatattttatgctcacaattctataaaagctaccatttaatatattatcttaaataacacatatagtttttacatatctgaaagaaggaagataatctaaaataatgattgcttctgtgtgatgacattattggttatttttattttctttgtactcttctgtattttctacaaccaatatttagtacttgtttttcagagtacaaaattgattttcagaaaatatgacaataatcaaatttgagggataccaaaagaaattatgaagctctgtgtagacctcctggtttagagtccctgcagtgaccggaggtcttctgccatttagaggagataaatgccatatctacattgaaagatgcggcacagatactattcaggttgacaaaagcatccgtccagcatgtttagcttcctaaggctttgatgtgtttaaaagatcagcaaagcttttcccttgtcttccctcatcacaacacaagttcaaagaaacatttattatgaaaaggctaaattctaacaaatgtatctccccagatttgaattacaatttaagtttctctataactttatcagaatttccccaacagctgagttaaagtactctattaattttcattagctgtttgtgattaatttgttctgttttaagtatcaaagtcaaaagaatgagacatgttattgttattgagcgaggaatgtaagaagataacagagaattaatgtagaaaagcaaactgtatctagattgagattgtctaactagctacttagtaatgaatttaaggcatgttaggaacatcagttagaatgtgggtaaatggtcatgtaaagccaaatccatgaatctgatttcctgttcatttaagaccaactatatttaattttaaacagcttctttccttttactattttttctaaaagcgatcaaagcacacaatgaatatgatttaaagagggtattttatgaaaatttccaaaatatctaatctgtctttaaatagagactaaaatccaaacacaaagaacattttaagctttatttaattatttttatttgaagtctttacatctcaggttctaaatgttgtacaaatatgaccagaatagttaaattattttagagttcagtagtaccagtaagtataaactaacccactactcaaaaaatgttacacatattataatttaattggcttttaacttttgaatgtagaaattatgataattgttctcacagtatattaaagacatttagagttgaggacaagagaaaaaccccacaaattaaaaaaacttttagcataaggcgttctgttggggataagagctttctttatataagtgggctttgttctggtatagcaagacaattttccttgcgtatttgcaaattatctaaaatgcaatgataaccttctatcaacactctatttgtgaaacagtaacctatgaggcccatactgagaaatttccacttctttttccactttgcaattctttgaatgatgtcttcttatcttcaaggtttcctctggccatttgacccctatctttaatgtcatgctttctgttctgtgctgttcagctcctcaccttcccacttttggttaaattcttcccttctttcagagtccttattatctcagacaaaggactggcacttcaggctatatgcccccattcttttcatgttcctatcaatgtccatctcttgcatcattcttatacattgctttaaattaaggtagaactttgctcatttctcttgagttgaactttctttctccactatttggttagttaataggacaggaaaacggtaagaaatcaagataatcaagatttatgagaggctgggagtgaagaactttagaaagtagcctcatctttgtcccagtgaccacttgccactactaagccaaagtggccatgaaattttccatttcgcacacatctaccactttggacagttaaggagaaatggagttaaagaagaaaggagtgtataaaaatgacgggagcagatgagactgaaatagcagtggaggggaaaagcaggagttggcatcaacacagaatttgggaggtgaatgaactgaaagtagcccaaagaataggaataacactcctttccctgtcccttcaagaattgcccaaaagttatacactttagtgagggttataagcctttgaaatctacccttgtatccataaagtgccaacattttagcttcttggtgtactttctttagctttttaaaaaagatacagcaccaacctaatagaaaaatattatgagatataataaaattttgaaagttcaatgacattatatgcagcatgaaaagaagtgtttaataataggacacagataaatgtttctttgttgtgatggctacaggtattgtcttttatcagtataattttaattttcattattctgacaatactgacttaaatgattgatagttgttggttttcactttaggacagcagagtgttacttaacatgaaattctgaaagaaaatgcttttgagaatttagactctggtggaataactttcttgatacacagctaacctttttttctaggaatttaaaatctaccgcctttggtaaactcagaaatgttgagaagaaaagagaattaggaatgtatgtgttgtcctttgctcaaaagaaaaaaaaaaaagaaaaaagaattgacagtcaaagaaagaatcaatccaaggtggaaggggagagacaaaacaaaagaaagaaagaaagaaaaaccatgtccatgtataaaccttagaaattaacatgagaaccacccccaagttaaggattggtttacatgatgacttgaaatatactttccatttaatatgagaaaaatatattctaatcaagtcttcctttgttcttattttttagcatttctagagtctatctgatttctcagttctagcgtaaaagtttgcatatgagttctaggtgaaataaatggcagtaaatgcttgttaatctaataactattatagcataatgttttacaatggaaaacattatgcttgcttctttcctacagatattatgcagattcattgaacatgtctttttgaaaatgtggtatacataaggaatgctgcattggataaaaattggtaaaatttcacttgtagggaatacttaggagcaagaatgtaaaaaaactacaccactccgttatacttcattaggtcatgtatctggtttactgaatacaatgaagaagaaatatgatatggtttattattttatatattcagatagataatagatagtctgagctatttccataattcactgccttgttattaaaaaaaaaacataaacctgatgagtgttttcaagtaggtaagttattttagtctattctttgaagcagagcaatgaaagctctataatgtccacataatagaccaacttactgtaatgtaataatcttggaggagatttaacacccattatctgaagacctaaaacctctagggaactgttatggttgctcagcactgctataggacctaaatgtaagaacagaaacatttctgaataagatccaaagtgactggggagaaatcatgggacagtgggttcatcatggaatttaaaatcagacagagctgaaccaggtctgccttatactcttttgattgatattgaacaaccctacttcatagaatttatgtaagtaatacattatttaaggtatggaaagtattcaacaaatagtggttattttatttctaaattccaactaatcttgtatgctttgcagaaataccatttggtgatgattgaaggtagagaggggaaagcaatattgtcttttctataatattctttaaaaagagtgtatgcatatcttgataacctcactctagcaataacatttgtgaatttaaaactatctggaagttagtaaatttttattctcagtccatgctaccacgtattccttaattagctgtctcctttataaaattatattattttagtcttaaatttgatcttcatgagtatcacaaacaaatcaatgcacacttatgaagtagcccttatgtattattaactataggatacaaagaagtagaagtcacactccagcatctagaccttacttttacttcagtcattgaaattcagtgtacattgtgttaggcacattctgtcaaaggacaaaacaatttgtgaaagttaataaatattagatatagatgtcacaaattcttttataacatataagtttctgaataaattgtatcaaaaataacttcaattggagttcaagggaacaaggattttggattaagaaatttatagaaagttttaggaaaaaaaaaaaaactaaccagaattcatttttcaaagtgctgtgtttactgattgccacgtataggttaagcactctagtaaaccacaggcaggaggaagacagagtacccttacataaagggaatgaaaatatttaggaagttcgttaccttgcccacactaaagttcatctacattaaaaaaaataagttgcttgctttgagatatttcagtaatttaagttggagaatgttgccgtctaaaggaaatccatgatgtctccaaatttggggatgtcagtctctctgttttacatgagtaaacagaatctagaacagtaagccaattctagcggagtaaagtgagtctctagattttattgcattgtctactagctccaaagcattaatcctcttccccaaatgcatcacatagtttggtaggatctcattagttatataataatttcctcaccattccatcaaagttccgaacttcaggaaagaagcatttccagagatgggtgcagattcaaatagaggtgggtgggtgtgtgttgcccttacatgaacaaataaaaataactcgtctagagtttatagttcatgacaggcattttgtttacaaaaataatttttcatttaaaagctctacttaaaaaatttttttgaatttaaatttccactttatgtacaagttaggtacaagtacttattccccactgaaatctatgctatgaatcctaaagtcttatcaaatgacaagaaaacaaagaatcattacaatcataacttatcttggatcccttaagtctaaagatccttaaagcctattgctaatattatagctcaaccataggaaatacgactgaagatcatgcattacctgattgtattatccagttttattcatgtttagcacaaactctctgatagctaattttacattaaaattctgtcttctaaaatgtgggacacataacattctagatgtttcatgctatgttgagggtatatgagatgcttctgaggtggcacatacaagtagtatgaaataacattaaatcataaaatgaaacacttcctgtttttcagttcttctggttatgtcaaggaaaatctcagtttattactaatatgtccttaacacctctggaaaacttgcttatctccctttccaacaaatgaaatctgaggcctcagacttagattcttttgccaaaacatagcatatagccacaatttaaccatggtatcttgtttttattatatttaattatgtgatcaccttctatttatggcaacagatattggctttccctttattagagtgatataataatttgtctttaaaaatacattaattttagtatacaaagtgagtcaatttgcaggaaaagaattaaggaaataataggatagggcctgacaaatatggcaacatttgtagtagtggtatgtgaatgactggtgttgagaaaatactgctaatgatggtttaacaacccaggaaagtaaaagctcttgctgaatgcagacagatcaaagcacaactctgattaaagaactagaggtgaacaaatgtgaatccagacataggggccaacagaacaagccaggttggatggccagagatctggtcagagtgcaagcaaagagacgtccatagagaacagagagacaggtgagactgaaaacacagaaaagctgtcagctccaagtctgaggcaagctgctagtccagcccaagtactttaatgcatcccattgccacagtccaattttatggattcatgcttgaatggggataaattcaggcagatgataataccatgtctgaataaagacaaactgttaggaaaatagcattttaagcaattgtatttgttactagggtactataaaaaccacaagatgtgtcatttgaaagttgttaaaaagattaaatgaatttttttattacaaaatttcaaacaaacagtaaaaatatcagatttgagatgagttatagttggggcaaaagttaaccttttttttttcctttaccaaaattagggttttactgttttgttttctctgtgtgtgtgtgtgtgtgtgtgtgtgtgtgtgtgttaaaccaactctctgacccacttctgcttccagggtcaaatattttgcatttccaatactcaggattgagagagtacaagttttccttcatgatgattttctgtggaacatttgctaataataactaagtttcagcattgttatgattttatagtatgtactgggtcagtggtttctaggggtcagtaaaagaaaggaagttttggaactttcaaaggatttcatttgaaaaaataacttttcgaatttggataatagcacttgtatattccttgtagtttccctgattcaaggcaataagcagtatatacaattacttgttagctcccttcttttcatgttgatagggaccacccatctgtggccttgggtgcctaaaaaactttagttattacaatcgagagtcacattagagattgtctgtaacttaaatcagcatatattatgtatatacactattttcaaatatatttggatatttttagtgacaaaataataaaatttattttaaagcatccacactagcttttcatcataatgtaggtataatgaccccatgtgggagtctgcaaaatatcttgaccttaaaaatagtcttcaaattccaaaacaaacaatatactgctggaaaataatgaatatagaatgagaaaatgggaagacttgatttgaagataccttgaggaaaaaaatcagtaaaataaaactgaacaaatagaatttaaccaagaatataatacttcagctaggttttatattttctgtttacaagactattaatgcattacaattttccattattattgaacttccattcatcttaaccaaagtgaatgaccattaccatcatcaatatctgacaatgtacaggatcattctctgcaacatgcttggggatctcttcacaaaaacaaccttattttgacctcaagctttcctcaaaatttctctccttttttttctttgcttcccttctcagaaatagaaagtttttccccattgtttcactgttcattccctttctcagctcaaaaaaaaaaaaaaaaaatcgaacttctacttgcctttcatcaggcaccaacaatgctgctcaatttcaactgtcttttctcatcttacccctccttgcatggcattcaacatagctgaccttctatacttggaaagttttctcatccatcttctgagatatcactctcttgatttttctcccatccctttagtacttctaagtcatttttctgttttcttctcttgctctactcagtatgaaaatattgggttgacgttggactcaggcctaagtgttctatgctgcctccacaggcacttctgtttcatgactttaaattcaatacatatgttgatgatgcccaaacatacatctccagccttgacctattctctaacctcataaacctctaatcacttaacggctgcccttgaaattctaatagtgatcttatctccaaaattaactgatttgtcctcctgaagctgttccttgtcccacagccttaatctcagcacaaaacaacaccacttactcttttcctcttatctatgtacctcccacccccatttacagtcaaacatgaacacttacttgttctgcctccaaaatgtcttgactctttcacttctctacagctccactgtcagtgctatccaaaaccatcatttttttctcatttgtatatttccttcatttttcccagtccccaaaataaagtgaattaaaaaaaacaaatataaaattatatcatgtttttcacttacatcaatccattcactagcttcccaaattaacatgtcaattaattttggagataacatcactacttagttagaataaatgtcagattttctagcatggcctacatgaccaggatctactttccaaacttctcccactactctctacttcacacaacattctccagcccacttggccttctttctttttcacacattgatttcattcttcagaactcatgcactctgcctgagctttatttccttgatttttgtatagcttactctacactttgtcattcaggtctcagtacatcgcctcataagtaaataatctgatacaaataatcggtctcaaagtagctccatcttgaactttttgcaataatagaaatgtttgataacttatgctatccaatatgtgagtgttgagcatttaaaatatgactaataatattgagaaacagaataattttatttagttttcttttactgtgtcaactaatttaaattaaaatagctatgcttggctagtgactactgaattgaataatgcagttctagcacagcatcttattttgtttcttaaaaaataaaattataaattataaatttcaaaaaatgaattaatatgcttttgaaaaatttatttctgttctctacagcataatcaccatgagggtggggatgtctttgttggtttgctttcatataatcagtacctagaggaaggccaagaacatagtaaatactcaataaatatttgtagaaaaaaatagataattgaatgaatggatgaatctatccctcatgaagttaagcatgagtcataatatctccctttcagactagtataactgcgtcctccctatgcttcctgggatgactcctgcctcactcgactctctccttcacgtcactgtcaaaagtgatcactctgagttacatatgggatcaagtcacactctcctgcctaaaacactttggtttttatgtcaccatcatgaagaaatgcgagcaaccctttataatatggtaacttttgcctagtctggctctgcccacctcatattttactcaagcaatattgatgtacttgccatttttcacacatcttagggcagtatgaatagaacttctttttgtttagcaaaactatatccatccttcaaaaactctgagggctgttctttgtgatgcttcgtccctggcaaatctttcttctcttgctaagaatcactcttttttggggggcaccttttatactttgcccaaatattgattgccacatgaataaatcatacaggacagcatggactgacctactttgcaattttagcacagagcaaaaggtctagctatagcacaaaataagtgctcaatcaatacttgctaattaaactcatctcatgcccttatagtaggattccattgtgctggtggaggggacccaatggctctgtctcaaggtttttattgttcctatagaaaaactattattttcttttttaccatttgtcttatatagaacaactgtttttagtgtctataatatgattttctttatgttgggaacatgctatatttttatttaatttagaaggtcagtataggagtcttacacacaatccctctggaatatgtcttttcctaagactgccacgatttgctataaaatgtaaatagaatgtgtctgggcaaaaatgtttgacaatatgtggatggttaacagaagctcctgaggattctacctgccatctctctataccatgaatgaagtagttaataaggcacaagtagacttgcaacttttttttaaaagaaatgtctcatatgttctgaaaagttgtgcatataaaggtgggttaacagtgagttattaaaaatataatttgcttttgtgaaaccactggcaatagtaggatgaaatattccataagtattaaacaaagttaacactaataaaacttactaatgggatagtcttgccatacttccttgccatagtaacacaacttactaatggagtagtctcacctagttctgaaaacagaactagggacagaagaaagggcacttaacatgggatctggattttataatcattttgacactaattgtgcatatttgtgttcaccagaccttctgagttgtaaagaaagttcagtgcaagtttctatcactcccatcccagataaggtggaacttccagccttcccattatctctagaggttcttaggagcaggttcctagacttagcaaataaaaatacagaattcccaattaaatttgaatttaagatatataacgaatggctttttattttaagtgtatttatattacatgcaatattttggacatatttataaaaagaatctgttatttatctgaagtccatatttaattggaagccatttaatagaaatccatatttaatttttatctggcagctctacatggggagaattctgggaagtggtgacttatgtttcccctcatcacctctgattctaaattctggcttaccctaaatgctcaatcttatgtgtccactacaattctgatttcattttctatgactcttcttccttatgctctgcactagttgcatggtgaaccagggtttctcttctttaatgtttccttccaaaactcgttcaagaaatttatgaacacagcagactttgcttaacatttgcagctaaaaagagactatagatctgtccagcttaaataatttaagattaaattaaagttgtgtttattttctaggatactttggttacattctctgcccctctcccactttctactttgagcaaatttctcataggcacttgtctctataatcttttgcctcattctgttttgtttcacctcctatttcttcagccatctcatctgtcttgctgcttaccccagcagccagataattattaaattcatatggaaagcaatttagctatcttttttttaccaccactttacaaattaaggtctttgtggtcttaatacttttaacaatgataattcttgcctaagaaaatgggaaagcattttctttatatatatatatatatatatatatatatatatatatatatatatatcagaatatatatatatatcagaatatatatatatgtgtgtgtgtatatatctctatatatgccattttatttgctctgctaggctttagtctcttattttgaaatcactaagttagatatggccaaagtgtacatgacatatcagtttgactcatacttcattttgaaaatagcttgatattctacttttgctaaggctaaatatattcatagaaaactaaaaaaactctttgggaatatctatcaataacttaaaaattttgaatactcttagacctaaacagttggcttctagacaagtatttgaaagtaataaagttgagtagttaaggtcatagtctttggattcctacagacctgggttcaaatcctagttttgccatctaaagttatgaaaagtctaagtctcatttgtttagtagtttgttatttggatgtactgtattgaatcatgtgagtgtctatttttctagaatatatttggaaaagtatactcaatagtgtatggctcagtgtaataatttatgacaaaagatgaacaacaggttcattccttttttaaaattaaacaaacacacacacacacgcacacacacatacacatctagagttgaaattgtccacgtcaaaaactgagataataagaatatcaaacaggattattgtgaatattttaactattgatatgtatctcttctaaatatatataataaatgtatattatctattatatacataaatggttaagtaaactaagatataactagaagtcagaatataagaatcttaaactaatacatatgaatattttaatgatatgaaaaagtatccatgagaaaagcctaaacccaggataaaatgtactgtatacagtatgatgtctcctcagattatccatttaatgtgtaattatataatcatagatacagggaaaaaaataaaaagaaattcaccaaaatagaacaacaggtacttctaggtagtagaattatgagtagctattttaatacctctttatctacatatttctaacaatgggcatgcaatactattagcaataaaaaagtaatgtttacatgtataaacatatgtatgcataacatatacatacatacaacacataggtgtgtgtatatatataatatacatatatgtccttaagttttatatattattgctgtgtattattttaaagaaatgtatccaatttaaaatgatgtatcaaatttttttaaataaaaatgttttattctatccatcattcatttcatgaaaaaaaaaatcagtatctaggtttagcaaagagattattaaattactatggctcattcttggttttgttccatgtattagatagcactttggttatttctttaaaagaatgtgattttggtaacttccaggttgaaagtttccaagttcagaaaacttgtttttatttgtatcatttggtagcttagtaaataatgcccgctgataattattatatttcacatggctaagaattttaaaagtacttaaagtaggtaaatatctattaattaaaattaaccttcttgggtaagactgcttactctggcattgttaaatgaagaaaagtgagctaattaagtttagcccgcattaaaatttgaattttattgtgtctaaaaatactcttattctcttatcctttttctttaggaagaagatgctaatctatggcagaatttcttatttatctcattcaaaatacactaatcagatacaaaagacatgctttaaacacatgacagtatgtgtcaattttcttatataaataagtggtttgatttctcacccaacaataaacagataataagatagatagacacataattggcaaaatgagtcagcagttcattctcatatttttgataattagagattatattgagatgtcctatatcaataacagatgtcaccttctctgatttatcccatttgatagaatctttttttaacagttcagtggttttccaaagatttaaaaatagaaatatctctgacgatttgagaactataagtaaaactaaagttaaatgttagatcaaaaataccgtttaattaaacaaagaaacatgctactctgtaaacttttcctctgaaaaccagaaatcaatgctttccaagtcagtcccatcgttggaatcttatctgtaaggaagaagacttccagattacctgtgactactttctatactaacatttctattaatattttactaccattattagtttgaaccctatgaatttccattcttgcaggataaatttggagagatggagtcaatagtttatgattcagtgtaataatttttgccaaaagataaacaacagttacattccttttttaaattacacacacacgtgcacacacatctagagttaaatatttactgatttatatcttgatttttacgtttaaggtctggattttccaagtgtgaaattctaatactactaatactactactactaattttaatactactaactcagtagtaaaagaaactaataaatatttatagaatcaatcagttatgccattatcagtgattccatctcagactaagtagggccaaaaattaattagaagcatagtccatgaaagaggagcacatttggggatgcactgcatgggtgaccatcattcagcactgggcacaacattgggactgataaagataacgccatgccacttacaccgttagcagggtgaggatttgagggactttcgatgcaattctttgattgaaatcttgtgctctgacagtagatttcaatggtttagtcaaagagttgcttgtacacaatgcaaaagctgccacagagggaactcatgcctggcccttcatacctctaaaaggggacaccaatacagaggtagcatgacccttaccagggccagggtacaagcctagctcttacattttaggaacaaaatatccactgtgcatttcgggaactccacctgactcctactcagctgctgacataactctgattgagacagctaatttttgagatcaacagtctaaagctcaaaaacatctatgaaagtatcttaaaacccacccctgtgctagtttagattggcaggagtacatgatttggacattctcctggggaaatgtctaagttctataattatgtttacccaggcttcttatgctgagaaaacattttccaggtacatttgattctaccaagagaacctttcaatttagaagatacctgagaagctctcattacggtatttgaaagtgctcccaggattccctctgtgactctttttcctcatcaataaaatattatttgtacctaacagaaggatttttctgagatttgaacgagttaattataatatgtcctcaataaatgctaacagaagttgtttttgacactattaaaaataaaaactttcagtcttcctaatattatatgctaggcttctcacaagaattgttgagatacgttcttagagaaaatgttttgtaatttaaaaaagatttcttagtatgacacaatgccatctgtaggtgcaatgaaaccaaatagtctctgtgttctcatttttattacagagacgcaactgatttcatagcgatcttatgatgattatgaatgagattatgcaggtaaatttcctagaacagtgtcttgtgaacactttcttcttagttaat

SEQ ID NO: 1644 - DNA, 63431 bp, Homo sapiens
cttgaagtcctaaaatttcgttgggaaatagataaattatcttgttgagaaggagaggccataagtggtgtttgaatagaaagctgtactgttgaagattttaaatggctcttgtaggtaacaggagaaagagcaagcaactgtgggagcagctcaagttggagaccataaaattaatattggcataaatctgtggggcattgatttcttctagacatttttatccaaatacaggaaataaagatagatagttgaaatgttccaagggttgtaaggaacattttagcataatcaaggcaatgaaatgaaagaactttagagacactggagagaatggacaaaataataattgaattaaagaacctcggagcctacactagaaatgaaaataaaagtgtataaaggaggttatttgatggatgggtgtcaccatatatttggaggatatgtgtggtggaagtaaaggaagaaaggagttgaggaagaaaggagttgaaaagatagattttagttataaataaatatataggagttgaagatttaagaggtggggcagttccaagtgataagaggatctttgtatgtgtctatggaaatcagtttattaacgtccggtaggataaagattgttggtgtccaaaaatgttgatattaggtaattgggagggctgttcttatgaatttggaagttaacaatgattatggcagaaattggatggagagaaaaagcttcataagtcaaaatgatgtaaagaccacagtaaatgaagatggtagtatgggaggtcaattgatgaccaaataaggacaagttgaagatgatgtaattgaaaaaccactttattttctagctcttccatgctaagtgataccctacttcaaaatggacaccctgctctcctggcttgaacagtatcatcactttctcagagtacagacatgaatatcttagaaaaacccctgactagcttttatctgatacatagattctttcatttcaaagtctatctttaattaatgcttaaatactcctgtgggtattttattaactttctaaattagagctttatggttccccttttttcttttactctttctcattccacatagcaggattagggagctacattctcaataatgacttcactagttatggaaatttatcagaatgcttttaggtcaagagaataaagaatcatcagcggaaaaagtatcagaattgaaaaatttcagaagtctccagttagatttcactttttgatcacatcttctttctgtatattgatacctaatctttatttgaaaatatttagagtaaaactcaaagatgcctactggaacatactactcgcataaccaaaacattgccctattcttatgtgctctgcaggttaatacttttgcagtagcttatgagagaagataattcagttaacatatattaggatgcttgtttgagtctgtattctttaaaaattaattatggccagatattcattttactgtgaaaaaactaagctgattaaattagattgatttgcactagatttgtatttcaatacatactagctttcattttcttttccaaaatacttttttaaattaaaataagttataggaaatatttccaaagcacacacagacacacacacacacacacacacacacacaccacaaagtgtacactaaagaaaatgattttaaatatggagggggaaataaatagtatttttcatacgtaataaagtattacataaaacacatcagtaaatagcttaaattgcttataagtaggaaaaggcaaatgcttttttttatttaaaacttctttctagcacaggcttttaaaaacaatgttgtttaaaaatttaaataaaataagcagttctgaagatctctaaatgtttctatacaagccttaaatatgtatgtacataatttggccatttgaaatagcactaggataaaactgtggctgaccagtttcaatctaatatcagagaaaaaatgtgtgaaagactttgaaagggtaaaataaaattactaggagtcctggctagtacacccttcagaactatctgtgcctttcaatctccgtgaacaattttacaactctaaattaagaaaaactgtgagcaatacaaatgattcttctttatagagatataaataattgtgttcagctaagttacgtttgattattgcccagtgaatattgactagttttgcacctatctgtgaatttagttcagcatttttgattgccaatatcaatatagacatagaagtagacatagacatagacatagatataatatatagatagataaatgttctttgaattctcataactgatttattctttaatgagttaaatgatatctttggcatgtgctcattttatatttatatgggtcatggttttatgttcttaaaaatgttccttggcaattaataaaatttaaattgactagctgtaagttaaaatattttgagtcaacaaagctcctactttaccaaatttggtttaaaactttaaaaccttcaccataaaacaatttctatttttgcaattctttgagaaagttttgtccaaagtgtgccctaagaattattttctgagatatttcttgaaaggaaagttttatggtaaaatacatgtgtaaaatgcaatatatctttctggtaggaatcctaatggtctttactgcacaactgtctactgagacttagaggctctttttaatcaagttgatgtttctcaagcaattgcactgtcaactactcttcataaactttctgctataggtacaggaatattcacgatctccttgatctcccctagctttacctattttgaactttccaactttgcttatcctcttctccttgcctcacctctctactataatggtctcctctcacctctctgcttttccaatgtgaatcaacaattgtacttctcctactactattttttgtaacaattgaaatgtatgcttatgtttgccactggactgtgagttcttagaggatcaagaatatcttattcatctttgtatggcagggcaagggagaatttaagtgaagtaacactctggtttagttaaggcttctctttgaaggttttgattttggagtagcaaaaaatgctgcccccaaatatggcacattggcacactatgtattttaagctgaaggaaactgagaaacttgcagaagcagaaagattgctctcaacttccgcctcctgtcttttaaacactgtgacaagtgccatgctttaaaccatgagggaaggaatattatatagaaaggccaagaagaatctgaacaaacaggccttgcttggtacccctcatccccagtttattaccattaggtcatacccttttctttttgttccaatcatacttctacaaaattgtctattcttcatcaaatctaagcataaaaatagttgtccctgggtcttcattttagaaagcttctaggtcacataacattttgatgaaataaatttgttatgcctttttcttgctaatctgtctttattatagaagtgtcagccataaacccattaatgtacccgaaattttaattgtctattcgtaatgtttgtgttattgctggtattattatgtaactctgttaatctcattgctttttgccatatttcccacctcaattttcagtttcttgggccaaatgatctttacatgactacatcacctgtaagagaactcttcaagagctagaaatgaattactacttgaattatttgaattgaaggtaggtactacttagtagaagcaccaatgatcacagaggggcagaaaaaaatgtgcagggcaaatttactgccatgaattaagcacttgtactaagaagtttacttagtctaatgattagtgaagctactttcgtaacttggttaattacatttttactctatgtttaatattattctgattatcttcattgtaaaagcatttagaaaaaatatacattgcttcttattctaaatgacttaagtacaaatatgtaaaaagcactctcttctcagtggttgttatatgacttaaatgagtttatatacaacctttactaattgaggttctcgcctattttcctcaagaaatgtgtgttgaataaatttgttaactaggtactatactgggcattgaaatagaaagatggagtgaataatacaaagacttgattattttcttgagggggtggggccaaaatggctgactagaagcagcagtgattggaggctgtcatcaaaaagaaccataactgcctccaaatcctgcactggcaactgaggtatgcagggtcttcatcaaaactgactagggccaggtgaggtgactcacacctgtaatcccagcaatttgggaggctgagggggacggatcacctgaggtcaggagctggagaccagtctggccaacgtggtgaaaccttgtctctactaaaaatacaaaaaacggcttggtgtggtggcggacgcttgtaatcccatactcaggaggctgaggcaggagaatcatttgggaggtgaagggtgcagtgagccaagatcatgccattgcactccagcttgggcaacaagagtgaaactgtgtctcaaaacaaaacaaaacaaaaaacaaacaaacaacaacaacaacaaaaaacaagaactgactaggcagctggtatgacccatggagaggaaggaagagcagtgtgctgtggtggcccacctaagagccacacggggcaggggagcccccacaccccagtcaagggaggtggtgagtgtgctacccagcctaggaaaccgtgctttttccatggaactgtgcaacccaaggattggaggatcccactcatgaacccatgccaccgggaagccatgcagattctcaacagccactcaactagaatctgcttaagactcccaggggaggggcaaccagcaccacagctgccgctgcctaatgtctaagctgcctgaggtccttaggggagaggcaccagccaacactgagactgatagctgcctaacacattaagctcccagggcgggtatggggcagcagccatctctatagctccaggatatgcttttcccctgatggagccagggagtctggatagcttcgtcccaagaggtatcccccacagcccaacacaccggctgtggcagactgcagccagaatgcctcttcaggcctgaacctgacccatccctcctcactgggtggggtctccctgcaggaactccaacaactccagccaggggctcagggacagaagcctgatctccctgggcctgagcccccagggtgaggggtggccacagtctctgcagaccagcagacttaacctttcctcctgctagttctgaggaatctgggcagcccagacaagtgggtttcccccccagcaaaacacacctttcaccaagggatggtcaaagtgcttcgctaaacaggtcctgctccctgtgccactcaactgggtgagactcttaaacagggattgtcagacaccctatacatgagcattcctactgagatcaggtaggtgcctctcgaggtcagagatcccaaaagaagaagcaggcactcatctctgctgttctccaacctcctcaagtgacatctccaggcacaggagtgaaccagatgaatagtgcttgaagcgaacctctggcaaacctcagcagccctacagaagagggacttgaccattgaaataaaaacaatcaaacagaaaacaacaacaatagcatcagcaaaaaagagttcccaactaaagccctatccaagggtgagcagcctcaaacatcaaaactagacatattcatgaagatgagaacgaatcaatgaaaaaatgctgcaaaaccaaaaggccagagttcctcctctcctccaaatgatcataatgcctctccagcaagggtgcagaactggacagaggatgagatgggtggattgacagaagtaggcttcagaaggtgggtaataataaacgccactaagctaaagaagcatgtgctaaagttcttagcaaagaaggtaagaaccttgataaaaagttagagaaggtgctaactagaataaccagtttagagaggaacataaatgccctgatggagctaaaaacataggacgagaacttagtgaagcatacacaagtatcaacaggtgaatcgaccaagtagaagaaacgatatcagagtttgaagactaccttgctgaaataagtcatgaagacaggattagagaaaacagaatgaaaggaatgaacaaaatctctgagaaatatgggactatgtaaaaaaaaatgaacctatgactgactggagtacctgaaggagatggggagaagggaatcaagctggaaaacacatgtcaggatactatctagaagaacttcccaaacctagcaagaaaagccaacattcaaattcaggaaatacagagaacaccactaagatactccatgagaagatcaaccccaagacacatatgggcagccagagagaaaggccaagtaatctacaaagggaagcacatcagactaacagtggacctctcagcagaaactctacaagccagaagagagtggggaccaatattcatcattcttaaagaaaagaattttcaacacagaatttcatattcagccaaactaagcttcataagtgaaggagaaataaaatcctttccagacaagcaaatgctgagggatttcatcaccaccaggcctgccttgcaagagctcctgaaggaagcactaaacatggaaaggaaaaaccggtaccagccactgcaaaaacacaccaaaatataatgaccaatgacactatgaagaaactgtaccaactagtgtgcaaaataaccagatagcatcatgatgacaggatcaaattcacacataaaaatattaacctaaagtgtaaatgggctaaatgccccaattaaaagacacagactggcaaatagtataaagagccaagacccatcagtgtgctgtgttcaggagacccatctcacgtgcagacacacataggctcaaaataaaggaatggaggaacatttaccaagcaaatggaaaggaaaaaagaaaaacaagcaagggttgcaatcctagtctctgacaaaacagactttaaaccaacaaaaatcagaaagacaaagaagggcattacataatggtaaagagatcaatgcaacaagaagagctaactatcctaaatatatacgcacccaatacagcagcacctggatccataaaacaagttcttagagacctacaaagagacatagtctcccacacaataatagtgggagactttaataccccactgtcaatattagaccgattaatgagacataaaattaacaaggatattcaggactttaacacagctctggatcaagtggacctaatagacatctacagaattctctacaccaaatcaacagaatatacattcttctcagtgccacatggcacttattctaaaattgaccacataattggaagtaaaaccatcctcagcaaatgcaaaagaactgaaatcatagcaaacagtctctcacaccacagtgcaatcaaagtagagctcaggattaagacactcactcaaaaccacacaattacatggaaattgaacaacatgctcctgaatgactcctgagtaactaatgaaattaaggcagaaatcagtgttatttgaaaccagtgagaacaaagacacaacataccagaatttctgggacacagctaaagcagtattaagagggaaatttatagcactaaatacctacattggaaagctggagaaagatcacaaaatgacaccctaacatcagaattaaaagagctagaggccggacacgttggctcatgccaactgaggttgatagcactggtcaagaggctgatgatgatgccatttgtgataataagaacaactcataactaagaggtagataggttttgttgcacaggtggagagatggggaaagacagagttattttattgccttatctttggtaatatattagtatattatttgttctttgttttaatttttcaaagtagaatgtactatgttacaaacagcatactaattattaggtcttaaaatttagcatgcaatattcacatgtaattgactttaatgcctctgttatatctaaattgtacctacctaacttttttcatttctttaagtaaattctttctatatttttctgcttttagtttttgcttaacaatcaggcttttctcttttaggacagcctcattcttctccagtctgtcaattttaagtagtcctctggtcaaaagagtgcgctcattatttaagttttgaactaataaacgctctgaagccttttgggatttttcttttagaaacagagcttttctctctctagctttttcaaggtagttgaatctgttttgccaaacttgtcgtaaactgttctgaattgtctctttattttcttcaattagtttttgtgtagcatattttttctgattcaaatgttcattaacagctactctaactctttctcgagcaacttgtgccatggctacaactcttactttttctttatggtattcctgcttcttttgttctgtgtaatatttgtcaatatcactaaatgttcggagtttcataccagctctttgtggtgcaaaaaactctttcatactccgctccaatcgtatgtcttttttaatgattggctttggatgagtagtatagattggctgaggatatgcaggaaaaaaatgttgttttttctctctcaatactgcattattcttcaatgaacctgaagtgtatatgggtagtttgaaaactgatatcctaaaactggtatccaatttttcatccacaatttcatcttcagactcctgacctacatcaaacagaagcaaatattatacattatacaagagctaagtacattttattttctctccaaatatatcaataaacttgataagaaccttttatttactttactaagaagaatttttcccaagtaccttttcaacttgtgatttaatagtaactttggagaagaaaatcactattaaaacattttcacatagaaatgcactgaatctaattcttatattttctgtattatcttccacaattacttaacttgcagtgactcaatagcagcaacttatcacatacttagtactacttaaccacacatattattttttcatatagtttgctaaaagaaacaaagtttaattaagcaaagaataattcatgaactgggtagcactgagaaccagtgaaaatttagaaaactctgcgtaataaatgagcagggagtatttatagatagaaaatggaagaaatatagaaacagcttgattggttatggttcaattttgccttatttggacataatcatatcagttggtggcctgtgattggctgaagcttgactgctgtgattggctatgacttagttatcttttacaaaaatatacctgtaagttaggctttcagtttgtttacatactaagttaggttgcaattcattatgtaaggactcaaggaacagaggcagccttaggccacatttaacaagttattagtatgtcatatttgcaaagggcattgtaatccattttaccttatttttcttaactctggtggaaaatagtagcagccatcaatcgtttttcccttttttggacagacaaaattactaaaactcttagcttcctttgctttcctttgtgtgaccatgggctaagtcctttttaatagagtgtgaacacaattgttatgtgttattccttgtccaagagattgttttaagaaacaatgtgcaccttctttccactacgtagagatgagaatgaaaccccaaaagatggtggaaccataagatagaagctgcctgcctgcctgaatcacttgttgaaaaaacttctcatggaccagaatcatccaagttgggtcatttatgaagccagaaatcaaaagtaattatgtttcagtcaatatgcatttctgggtctatttgttactatacccaacctaattaatacaataaattgaatcacattgttgtttgcatatttactttttgacaaacctactaatgaattcagaatcaggtgacaaatacaagtataaaagttatgcttgttaatttaggagaaaaaggtgtttcttgatttcttccacttattaaaattacattcctgctaactctagtctacaagggtttgatcttccttagaaaattaccttgtctttatgtgtaaaaatgtcaaatatgatgctggtggttttatggaagttaagtgaactatgaagaagggcagggcttgtagtctagacggacagtagaaaataattgaataggcaagattttcacgaaaggctacaggagtatcaacgttggaaaagtaagtaaattctacagcaaagtaggaaatcaagtctagcaaatagaaaaggcagtccatcaggatagaaagccaaagtgtccagaaataaacactaaatatgtgtgtccaaagcaagagactgaggagccaaagtgtcaaaagtcagagtctctcattagttggttgaacatagtcccattaacacttttaaaagtctcctaatttctttctctgttttcagaatctctgtttcaagaaatcactcactgctatatttatctttcttaagtagggttctaacaacattgtaccttatacacaaacaaaggaagacaaaatctttatggctttccacccatagtctgaagaatagtttccatttttggcctaggattatataataccagaaaagagcgacatatttttccccaacatatgcatcatatcttatcatcattgggcctttgcttctattattttaagttttgctcagtatgctgtttttcttatctgtatctgttcatattctatgcattcttccatgtcttttcacgtcatattttccttattgcttaaaaaagaattcatatgttttaaactatcacatatgtttttcctgatagaattaatcatattccacttacattaaagctctatgtagtagtttttagctataggatcgaacttgatataaccttcttatgagtaaggatctactcctttggtctttgatgctacattcccagcccctagcctactattttgcacagtttggtttgtgcagcaatgtagtttagatgtgtgtcccctccaaatcccatgttgaaatgcaatccccaatgttggatattgggcctagtgagaggtgtttgggacatggggtagacccctcatgagtggcttggtgccctctcgtgataatgagagagttcctgttatggtagttcatatgagagctagttgtttaaaaaagtctggcacctctgtcttcatgtgatatgccagctcccacatcaccttctgccataatattaagggaaatttatagctctaaatgcccacaggagaaagcaaaaagatctaaaatttacaccctaatatcacaattaaaagaactagagaagaaagagcaaacaaattcaaaagctagcagaagacaagaaataactaagatcaaagcagaactgaaggagacagagtcacaaaaaacccttcaaaaaatcaatgaatccaggagctggatttttgaaaacatcaacaaaatagaccactagccagactaataagaataaaagagaggagaatcaaatagatgcaatcaaaaatgataaaggggatatcaccaccgattccacagaaaatacaaactaccatcagagaatacgataaacacctctatgcaaataaactagaaaatctagaaggaatggataaattcctggacactacactcttccaagactaaaccatgaagaatttgaatccctgaatagaccaataactagttctgaaattgaggcagtaattaatagcctaccaaccaaaaaaagtccaggaccagagggattcacagccgaattctactagaggtactaagaggagctggtaccattccttctgaaactatttcaaacaagagaaaaagagcgaatcctccttaactcattttatggggcaagcatcatcctgataccaagacctggcacagacacaacaaaaaaagaaaatttcaggccactatccctgatgaacattgatccgaaaatcctcaataaaatactggcgaactgaatccagcagcacatcaaaaagcttatccaccactatcaagtcagcttcatccttgagatgcaagccttgttcaacatatgcaaatcaataaacataatctagcacataaacggaaccagtgataaaagccacatgattatctcaatagttgcagaaaaggccttcgacaaaattcagcaggcttcatgctaaaaatgttcaatatactaggcattgatggaacgtatctcaaaataataagagctatttatgacaaacccacagccaacatcatactgaatgggcaaaaaccggcagcattccctttgaaaaccggcacaagacaagcttgccctctctcaccactcctattcaacatagtattggaagttctggccagggcaatcagacaagagaaagaaataaacggtattcaagtaggaaaagaggaagtcaaattgtctctgtttgcagatgacatgattgtatatttaggaaaacccatcatctcagcccaaaatctccttaaactgataagcaacttcagcaaagtctcagggtacaaaatcaatgtgcaaaatacacaagtactcctatataccaataaaagacaaacagccaattcatgagtgaactcccatttacaaccactgcaaagagaataaaatacctaggagtacagctaacaagggatgtgagggacctcttcaaggagaactacaagccactgctcaaggaaataagagaggacacaaacaaacggaaaaacattccatcctcatggataggaagaatgaatgtcattaaaatggccacactgcccaaagcaatttatagatttaatgctattccgatcaggctaccattgactttcttcacagaattggaaaaaactactttaaagttcatatggaaccaaaaaagagcctgcatagccaagacaatcctaagcaaaaagaacaaagctggaggcatcatgctacctgacttcaaactatactacaaggctacagtaacacaaacagcatggtactggtaccaaaacagatatatagaccaatggaacagaacagaggcctcagaaatcatgccacatatctacaacaatctgatcttcaacaaacctgacaaaaacaagaaatggggaaagggtaccctaattaataaatggtgctaggaaaactggctagccatatgctagctgaaactggatccctaccttacaccttatacaaaaattaactcaagatggattaaagacttaaacctaaagccataaaaaccctagaagaaaacctaggcaataccattcaggacattggaatgggcaaaggcttcatgactaaaacaccaaaagcaacagcaacaaaagccaaaatagacaaatgggatctgattaaactaaagagcttctgcacagcaaaagaaactatcatcagagtgaacaggcaacctatagaatgggagaaaaattttgcaatctgtccatctgatgtaggcctaatatccagaatctacaaagagcttaaacagatttacaagaaaaaaaacaaacaaacccatcaaaaagtgggcaaaggatatgaacagacatttctcaaaagaaggcatttatgtggccaaaaaacatatgagaaaaagctcatcatctttggtcattatagaaatgcaacacaaaaccacaatgagataccatctcacaccagtaagaatggcaatcattaaaaagtcaggaaacaacagatgctggagaggatgtggggaaataggaatgcttttacactgttggtggaagtgtaaattagttcaaccattgtgggagacagtgtggcgattcctccaggatatagaaccagaaatacccagcaatcctattactaggtatatgcccaaaggattataaatcattctactataaagacacatacacacgtatgtttattgtggcactgttcactataggaaagacttggaaccaacccaaatgcccatcactgatagactggataaagaaaatgtggcacatatacaccacagaatactatgcagccataaaaaaggatgagttcatattctttgtggggacatggatgacactggaaaccatcattctcagcaaactaacacaagaatagataaccaaacaccacatgttctcactcataagtgggagttgaacaatgagaacacatgggcacagggagaggaacatcacatactgggacctgttggggtgtgatgggctaggggacggatagcattaggagaaatacctaatgtatctgatgggttgatgggtgcagcataccaccatggcacgtgtatacctatggaacaaacctgcacgttctgcacatgtaccccagaaattaaagaaattaaagtatatatatataaaaaagaggcctgatagaggtccttcaccctctaccatctgtgagcacacagccagaaggcaccatgtataaaccagaaagtgggttttcaacagacaccaaatttgttggtgtcttgttcttggacttcctagcctccagaatgattttaaaaaatctgttgtttataagctacccagtttatggtattttgttataacagcccaaatagagccccaacccccagtgtggctttatttggtagtgggacccctcagaaactgattaaggttaaatttggtcataaagtgaaaccctgattgaatcaggttagtgttctcatgagaagaaatatcagatagctcactttcccttctcactatgcacacatatcaaagaaaggccatatggacacagcaagatggtggttttctaaaaggcagagagccctcactagaaacttaccatgttggcatcctgatctcagactcagactccagaattgtaagaaaacaaatttctgttccttaagtcacccagtctggaattttgttatgacagcttgaacagactaacacaaaggaagttccctctcctgaatttttaagtaaagttgcccaactggtatgctgtggcaaactagtgtgttattaatggataataggagtgctcagagacattgatcaccctgggatggttatttatttccattttacttcaattttaattgatcctagcatgtcaataattcttctaatttggagaggggagtataatgttcctagaatgtccaaaatgtgaccatttgtccagtcttgggtctcatatctcaatttcattgtgttattaatgtaacagataacaatttcccccataacctcccagcagctacttaaaattacatatgatctcagtgaacgattaagtagcttctggcttcctagaatcattttgattcattcaccaattaattcatctatctatccttccatccattcattcatattttagtagcttgcaaattctatggaaattcagggatcacaaatataaaagttattattcaaactttctttagttcttaactttttatgtaaattttttttcctttgtgtttgagagttgttttccatgaatattagcagtctgtctttactcgtaaatgttttctttgttaaatatagaagtccaataataatataatgtgtgaacagtgtatacataaaattgaatgtttgttgtgtataagacacttttctaaacaaaatacatgaggtatttactaagaaatgcactatcccagggctcatgaaacttctagtggagaagatggataacaaatttataaataagaaaatatcaaatagaaataaatgctctgataaaaattaattggcagtgagagggtctagtaattagattgggtggataggaatgggtttttagaggatatctgatttaaccctagatgagaaaagataagtaagaacaagcaaggagaaaaaatgaacattccagaagaaaagagaagctaatataaaggcagtagacagaagcacatttagcctgctagggatacagagagaaagccacctgaaatccactaagtaagaggagagtggtgctggagacgctcacagaggtaaggcaggggccagattctatgcggcatggtaggtcacagaataaaagttttggatttcattctgagatttgaagtcgttgaagtaggggactgatatggtatgtgatttaccatgaagacaatggatttgaatgtggaccgtaaaattctaagtaggggactggttaagaggctactctagtggcccaggtaagattttatgataggaagggcctagatgaaagcaataaattcacagagaagtagaaagatttggcatatgttttacaagtatagtcagaaggggctgctgataacttagatagcagaagtgagaaagaaaaaaatcaaagatgaatggtagcattttggcttgagaaaccaggtgaatggtgatgccatttgctgacatgggaaaaactgcaggaaaagcagatttggtgagctagaagaaatatttttatatgtattactgttttgcagttcatacttttcatatttaaacacataactaacattttcctaattcaacgtcatattcaaattgtttatattaaaaaatcatttaaaactttcactaatgtaatgtcattttaaagtattttattcttaaaataaaatcattttgaacaaataccatttatttccatttacatgattcctagtaatactcaggttaaaactgaggaaaatgacacctttgtgtcttttttttcttttttttttttttttgagacggagtctcactctgttgcccaggctagagtgcaatggcatgatctcagctcactgcaacctccgcctcccggattcaagcaattctcctgcctcagcctcctgagtagctgggattacaggcacacaccaccatacctggctaatttttgtatttttagtagagatggggtttcaccatgttgatcaggctgctctcaaactcctgacctcatgatctgcccacctcggcctcccaaagtgctgggactacaggagtgagccaccacacccaccttgcatactttttaaataataataccagataatacttgaagtacaggttctcctttctccagccataacttccacaaactgaattttttgacacaaaggcaacaaaatggcttgttttagatatagtattaaagaaaagcttgctaaaaagcaattattcttatatttataccttatatgtacctctcaacttaagagcaaaacaactggatcatatcagccaatttactttcagttttctgaacagatagttggatcttttaggactcagagcaacacagaagccaataccatttgtggtcaacagagcttgtttgattcttctgaacgtattgcagatttatgaaccatctgtgaagaaacaaatggtccaaacctatttaaaatcagcatagctgtgatttgaatgctcacaagtgggtctgaagcagttgctttcctcagcaaactggcctgacacctttgcacaagcttatagccttatgtgatacataagctttaagtttaggtgaagcaaagaacaggaaaataaggaaaatgaaacgaatataaggaagaaagcagtggcataaacttctgtcacgtactgagttcttcctgatttgctagatgcaaaaagttcacttatagcaatggttgcaatttcttcctattttcttagtagcaaatgttttcaatgaagtctctcccattacacacgcacatatactctggtataaatgacttatctaagatatggtataagatcaccataataaagaatatagtttatgaaacatcttacatctcacatgtaataaagctctcctggggatttattgtaatagaatagaaaattacagagatgcacaggcgttacccctctcactttacatctttaatcaatttctgaaaattagacattctgtaaagaagtgctatgctggagcctatttctttatattctacatgggaaaattgtaacacattaaatgttaaccaccaacccttattggatttccaaaaatgaaaatagagcattaaaacattaaagcaggaaaacacactaaaacatgaatttataagtaccgttcacactaatgtacaaattgcttaaaacattgctttttgattatcagttattaaggctgcttacaaatagtatccattgcaatgatgtgactgttagtgacaacgtctcaaatagccatacctattgttgacatttggcatgctttaaaagttcctacatacgattttaaaaacatccgtattgagatatacttaatattccatattagtggtatattaaatcattaaagtgtacaatgtaattgttttaatacatttatagagttgtgcaaccataagttatcaccacagtctaggtttagagcattttcatcaccccaaacagaaaccccatacgcattagagtcattcaccatcccctgtctcctaccatctcccccaccttaagcaaccactaatctactttctgtctgccagattttcctattctggacatttcttataaatgcaatcacacaatatgtgatcttttataaggggtttcattattctaaggtagtaaattacagctttatgatacgttcccttttaaaatttgccttttatacagtttgccttcgccactccactctgagttctacctgtctggtaattttaggtagaacaaaatatttaaaccaatttcatacctggccataaagagtgaaaaaaatagactgggcaagtttgacttaggattaaggtcaaactttctacaggttcctgaataactatgaatcagtccgttaataattatattatttcccttttcccaagcttaccatttctttcatcttctaaggatcatgacgcttcaatctttttttcctctaagatcaggatcttaatttgaagatctaaatttctctacttgatatcttaggcccaaatatgtgagttccaccaggaccgcgctgactacataagtcttactagtccgatgtccactgaaacagtgctttggatctaactttctctttttttgagccattggacagctacagccactgttggatagtagttagggtgaaaaaccaggagcacaatcacttgcatatctgaaatgccacatcctatcatttcagaaagtaacttcatggaagttactcaaattcacgatgccatagtttcttcatctataaaatgggagaatgaaagtgcccaccttatagatttgctgtgagggttgagtgaaatctgcttggcactgaggaagaaattataaaatttagttgttcttcttatatcagctctcaatttcattttttgatctaaaacttcttatgttctcgataatggtagacatctctaatatcctcaaaagcctttctcacactgcttttctcacactctgggcagagagcggttattcattggagaagattataagccaatacagatttactatctttatctgatataataaattttgcttaatctcttattatataacaattacaaatccctctctgagctcttctctctgtggaatatattcaatctgcagttcctttttttcataatgtgtattatatctgacttctttaaaacaaaataaattctagattgtaggaatcttacacttgatcttaagtcttcaattaattttgatttaacaatttccttgttcactattctttctggtttttaaaaataacatcttctttgagatacaattcatatgccaaagaatgtatctttttaaagtgtacaattacaataatcaaaacagtttggtattggcaagagtattgacaaatagatcaatggaacaaagtagagagcccagaaatagatctgtcccgtgatatagtcaacttatctttaacaaaagagcaaaggcaaaacaatgaagtgagacagtcttttcaacaaacggtaatgaaataaccggtcctccacatgccaaaaaaaaaaaaaaaaacaaattaatctagacatagaccttacacccatgacaaaaatcagtttgaaatggctcatagatttaaatataaaatgcaaaactataaactcagagaagaaaatggaagaaatcctatataattttgagtatgacaataacttctttaaaaaaaccaaagttccatgaaagaaataactgttaatctggatttcattaaaattaaaatttctgccctgcaaaagagactatccagagaatgagagagcagccacagacttagaaaactatttcaaaacacacagttgataaagaacgttattaaaactcaacaataataaaataaacaaccagatgaaaaaatgagcaaggggctgggtgcactgactcacccctgtaatctcagtactttggctaaggcaggaggattgcttgagccagagtttcaggttgcaacaggatatgatggcaccactgcactccagcctgagcaacacagccagaccttgtctctaaaagcaaataaataaataaataaacaaatggacaagagacttccttaaagaaaatatacagatagcaagaaagtatataaaaagatgctccacatcatatgttattagagaattgtaacttcataagataacactacacacctactagaatggccaaaattcaaaacattgacaacaccaaatactgatgaggttatggaacaacaggacctctcattcattgctggtaggatgcaaaatggtaccaccactttggaagactggcagtgtttacaaaactaaagatattctcactgtaaaatccagctgtcatgttccttggtacccatcaaaatgaattgaaaactttgaaaacttgtgtctgtacaaaaacctgcacatggatatttatatttaatagcagctttattcataattggcaaaatatggaaactaccaaatatactttagtaggtgaatggataaataaaccttggtatatccagaccatggaatattattcagtgctaaagacttgtgctatcaagccataaaaaaaaaccacgaaaaataaatgcatattattgagtgaaagaagccaatctaaaaaggctacatactgtatgattccagatactggtatacaatatgtgtgaacaggtaaacctgtaaataatagtaaaaacatcagtggtagccagggataaggtggggaggataggatgaataaggagtgtagaaaggatttttagggcagtgaaatgattctaaatgataccgcgatgttggataaatatcattgtacgtttttcaaaactcatagaatgtacaccaagagtaaaccctaaggtaaattatgatcttttgcagataataatgtgttagtttaagttcatctattgtaacaattgtaccactatattatatgtggtgtgggatgtggataatgaaagaggttctgcgtatattgaaacagactgttatggaaaaatctctgtattttctgctcaattttgctatgaacaaaaactgtcctaaaagtttattaattacaaaaaggaagaaaacacaaatatatatatatatatatctatatatctacatacacatacatataaatacacacatacatacatacatatacacacatacatccacatttttaatgcatgtgtatatatgtatatattgatgtgcaattataaatataatttaaaatacaattatgaattacaactataaattatataaaatgtataattgtattacatattatgaattatataattatataaaatattataaatatataattatataaaatttaaaaatatattttaaataatatgtaaatataaatatagcttatataaatacccacatacatattaagtgtgtaatccagtgggtctttgccactttttatcacagaataacacaaccatcatgacatgtatgcacatacatacacatgcatacatacacatacacacacatacatacatatacactttatatatatatatatatatatatatatatatacacacacatacatataaagggtatgattcagtgtttttctgacactttgtcacagaataatgcaactatcatgaatacctaattcaagaacattttcatcaccgtagaaagaaagcaggtatctattagcagtcatttcttgttcccccctctcttctgcccctgacaactacaaacctattttatatctctataggtttgtattttctgggcaattcatatacatggagtcataaaatatgtgttttttgtgtcttctctcttatttaacatgtttgcaagaatcatccatgttgtaacatttatcagtatttcattcctctttgtaattgagtatcattcattatacatattcattatatgcccaggactgggcaatgcattttttacttactggttgatggatatttgatttttttatttgtttccacctttgaactgctttaagtactgcttctttcatatacaatttttatgtggacatatgtttatgattctcttggctatactgctagaaataaaattaggggttcatatggcaactgtttaatgtttgaagactgccaatctgtttttcaaaagtggctgtatcagatgcaggaaaagcactcatgaaattaaacaccctttcttgataaaaattgaataaagtcctggcatgttggctcacgcctgtaattccagcactttgggaggccgaggtgggcacatcacgaggtcaggtgatcaagatcatcctggctaacacggagaaagcccgtctctactaaaaatacaaaaaaattagccgggtgtggtggtgggtgcctgtagtcccagctactcaggaggctgaggcaggagaattgctccaagtcgggaggtggaggttgcagtgagccgagatcatgccactgcactccagtctcggtgacagagtgagaatctgtctcaaaaataaataaataaataaataaataaataaataaataaataaactcaacaaattagatatagcaggaacatacttcaacacagtaaagaccatatatgacaaaaccatagctcatatcatacacaatgggaaaaattttaaagctttttctgtaagatctggaaaaagataaggatgcccactctcaccacttgtattcaacatagtactagaagttgcagccagagcaattaggcaagagggaaaatagggatccaaattggaatagagaaagtcaaactgtccctccttgcagatgacatgatcatacatataaaaaactaggaagactccaccaaaaaactcttagaactaataaatcaattcagtaaagttgcagacacaaaatcaacatacaaaaatcagtagtgttttaatacaccaatagtgaactgtctgaataataaatcaagaatgcaatcccatttacaataactacaaaaataaaataactagaaataaatttaaccatgaaaagaaaatatttatataacataaaatacaaaatactgatgaaatagtttcaggaacacaaaaataaatggaaaactatcctgtgttcatggattgtcagaattagtattgttaaaatgtccatactacccgatatgtgtccccaaccaagtctcaacttgaattgttacccccacatgttgagggagggacctggtgggatgtaattggatcatggaggtggtttctcccatgctgttctcatgataatgaggaagttctctcaagatctgatgttttaaaagtggcagtttcccctgcactcactctctgtctcctgccaccatgtaagatgtaccttgcttcccctttgccttcgctatgattgtaagtttcctggggcctccccagccatgcagaactgtgagtcaattaaacctcttttgtttatagattacccagtttcaggtaatatctttatagcagtgtgagaatggtctaatatactacccaaagtggtctacagattcattgctattcctatcaaaatactaacgacattcttcacagaaatagaaaaaaattccccaaattatataagatcctgaatatccaaagcaactctgagccaaaagaatacaagttactatagctttttagtatattttaatgtcaggtagtggaagcatagtacctgacattaaaatatactaaaacggtatagtaaccaaagcagaatggtactggcataaatggagacacatagatcagtggaacataatagagagcccataaataaattcatacattcacagccaactgattttagacataggtggcaagaatactcattcaacaaggacagtctttttaataaatggtgctgcaaacactaaatattcacatgcagaagaatgaaactagacccctatctctcaccatataaaaaatctactcaaaatgcattaaagacttatatgtaagacttgaaactttgaaactactagaaaacaaaagagaaatgctgcatgacataggactgggcaaggactttttgaaatagacttcaaaggcacaggtaacaaaagcaaaaatagacaaatgggattacaccaaactgaaaagctgctgcacagcaaaggaaccaatcagcagaattggagaacatattcacaaactatacatgtgataaggggttaatatcaaaaatacatagggaactcaaactcaatagctaaaaaaacaagcaacccaactaaaaaatagtcaaaatccctgactagacatttatcaaaagaagatataaaacttgccagcaggtatatgacaaaatgcttaatatcaccaatcattaggaaaatgcaaatcaaaacagtgagatattgcctcacccctcttagaatggctattatcaaaaaaacaaaaaacaaaaaacaaatactagtgagaacacagctaatggagaactcttatacactgttggtaggagcatacattagtacaatgactatggaaaatagtatggaggttcttcaaaaaactaaaaatagaagtatcatatgatccagcagttccactactgggtgttcatccaaaggaaatgaaattagtattcagagacatctgaactcccatgtttgttgcagcactattcacaatagccaagaaatggaataaacctttgttcatcaatagatgaatggataatgaaaatgtggtatatatacacaatggaatattatgcagaaataaaatggaatgaaatcttgtcattcgctacaacatggatgagcttggagaatgttatattaagtgatataagccaggtacagaaagacaaatattacatgttatcttgcatatatggaagctaaaaaagtttgtctcatagaagtaaagaataaaacagtggtttccagaggctggagagtgttggagaagggaaatagtcagaggttggttaacagatacacaaatagataggaggaataggtaagttctagtgttttgtagcactggggagtgactatcatcaacaacaatttgttgcatgttttcaaatagctagaagagtggacttttaatgtatctaacacaagggaatggtaaatgtttgaggcgatgaatattctaattatgctattgatcactgtgcaatgtatatctgtgttgaaacatcatactgtaccccataaatatgtataattattatgtattaattacaaacaaaatagaaagtaaattgatgtatcattttacatccagcaatgtatgtaaatccatctgtaatccacaaagtttccaatttctccttatctttgccaaccctttgcactgtctgtgttttttattatagccatctgaatgggtgtgaaatagaatctcattaaattctttatttgtattgccctggtggccaaagatgttgtaagatatttttaatatttctggatacaagtccatagcagatatgttatttgcaaatattttatcttactcagcgagtgtcttttcactttcttgatggtatactttgaagcacaaagtggtttattttttcaactttgatgtggttcaatctttcattttctatctgtatttatttgcttcctttttttccttttcttattatttttggcttatgctcctagtggcatatctaaaacatcgttgcccaagttaaggttacaaaggtttactcccatcttctcttttaagacatttataattttaatgcctatgtttagatctatgatccatttaaagttaatttttgtacatggtgtgatgtagagatccaacatcaatttttgaatgtagatatatagttgtcccagcaccattttttgaaaagactattctttcctcaataaattatcttggcacacttgtcaaaaagttgtattgccttgatctaaatgtctttcattatgccagttttcacattgtcttaattactgtagctttgcagtaagtttcaaatcaggaactgtgagttcttcaaatttgtttttatttttaaagatcatttggttgttggaaatcccctacattctatgtggactttaggatcatcttttccatttctgaaaagaaaaagcattgaaattttgatagggattgcttgtatctctatattgctttcagtagtaatatcatcttaattttaagtcacccattttaagaaaatgagtgtctttccatttatttagatctactttaattcttcagtatagaagtcctgtacttccttcattaaatttattcctagttattttattcttttttgttgctattataaataaaattgtattcttaaattattttcaaattattcgctatataattgattttcaaatatttgcgtatttttatacttctaggaaagtgttcatttcatctaacataaaatttctttgcatattgttcattgtattcctttatcatcctttttatttctggaaattttgtggtaatgtcccctgtttcatttctgattctagtaacctgagtcgccttcttcttcgtcgtcatcttcttcttcttctttttcttcttcttcttcttcttcttcttcttcttgttcttcttcttcttcttcttcttcttcttcttcttcctcttcctcttctttctcttcctcctcctcctcttcctcctcttcctcttcttcttcctcctcctcctcctcttccacctcctcctccttttcttcttcttcctcctcctcctcatcctcttcctcctcctcatcttcttcttttctacttctttttttcttaaggtggaaagttaggttatatatttgaagtatttttgcatttttaatacaggtgcttacagatataaatttcattctcagcactgctttagctgaaactcataagttatttttgttttcacttacctatctatattttctaatgtcatttgtaatttttttctctgatccattggttattggagagagtatagctgggtgtgatggtgcatgactgtagtcccagctaatagagatcacttaagcccaggagtttgagttcacagtgggcaacatagcaagaccctgtcacacacacaccaaaaaaaggtaggaggaacatctgccaccaagggaccaggacatcaggaagaccggtgcactccaagcagatcttcagaaggaaggcattgagagtggacagagaggaaacactgctaggttgaaggggcaggaatctgggacctctgcatgtagctaccacacatcaggactcattttgacccccagtgacttctggggaaggagtgagtttagcaggcaagaagcgtcccactctcaccacagacctctggaattctggcagcgggagatgtcacaactttcaaggacacttgagctggcagggaaagctgcttagagaggtggaggggcaggacttgatctgatatatgacctcagcaaagtttcaggatatgaaatcaatgtacaaaagtaataacatcctcatactccaacaacatccatgctgagagtcaaatcaagagtccaattccattcacaatagccacaaaaagaatgaaatacctaggaatacagctaactggggtggtgaaagatctctctcatgagaattataaaacactgctcaaagaaatcagaaatgacacaaacaaatggaaaaacattccatgttcattgataggaagaatcaatactgttaatcaatattgttaaaatggtcatattggccaaagtacttaacagattcaatgttattcctatcaaattatcaatgacattcttcattgaattagaatattttaaaattcgtatggaaccaaaatacagactgaatagccaagacaatcctaaacagaaagaacagagctggaggcatcacattacctgacttcaaactatactacatttgcagaaaatgaaaactcgaccacttccttataccatatagaaaaatcaactcaagatatattaaatacttaaatgtaaaacctaaaaccatgaaaaccctgaaggtaacctaggaaataccattctggacatgggaccaggcaaagatttcatgatcaacatggtaaaagcaattgcaacaaaaacaaaacttgacaaatcaggttgggcatggtggcttacactagtagtctcagcagtttgggaggcctagtccggtgaattgcttgagctcaggaactggagactaggctgcataacttagtgagaccctctctctacaaataatacaagtatagccaagcttgctggcacatgcctgtagtcacagctactagagaggctgaggtggcaggattccttgagcctgggaggctgaagttgcagggagctgagatcataccactgcactccagcctgggagacagagtgagagtttttttcaaaagaaaataaaattgaccaatgggacctaattaaattaaaaagcttcttctgcaaggcaaaataaattatcaacaaagtaaacagacaacctacagaatgggagaaaatatttgcaaactgtgaatccaacaaaggtctagtatccaaaaacctatagggaacttaaatatacaagtgaaaaataaccccattaaaaattgggcaaaagacatgaaaagacacttttcaaaagaagatatatatatgaccaacaagcatatgaaacaatgctcaatatcactaatcattagagtaatgcaaataaaaaccacagtgagataccatctcacaccagtcagaatggctattactaaaaagtcaaaaaacgacagatgctgccaaggttgtggaggaaagggaaggcttatacactgctgatggaaatgtaaattagttcactcattgcagaaagcagtttgacaatttctgaaaggacttaaaacagaatgagtactcaaaggaatagaaatcacagcactattcacagtagcaaagacacagaatcaaccttaatgtccatcaacagtagactagataaagaaaatgtggtatatacacaacatggaataccatgcagccatgaaaaagaatgagatcatgtcctttgtagtaacatggttggagctgtaggccattatcctcagcaaattaacacagaaacagaaaaccaaataccacatgatatcacttatgggagctaaacatcaagtatatatggatacaatgaagggaacagcagacattggggcctacttgaaggtggtgggtgtgaggagggtgaggagtgaaaaaatacctatcggatactatgcctattacctgggtgaggaaataatctgtacaccaaacccatataacatacaatttatatatgtagtaaacattcatatgttcccctgaacctaaaatagaagttaaaaatagaaagtaaaaacaattaaataaaatagatactcaagtagtcctaaaataacaaccactaccaaagcaaaacaaaacaaaaaaaatcaaaacaaaacaaaacaaaacaaaaaaccccaaaaccaaacaacaacaacaacaacaacaacaacaacaaaacgaggaagggtgtttcctaatttacacgtatttgtatatttgtgagatttcaaaattttcttctatcatttctaatgtaatctcataatgaataaagaaaatgttttgtatcatttccatcttttaaaatttcttgattcttttcataacgtggtatacttgtatatggtttaaactggaaaatattccaagcacacttgagaagaatgtgtattctgctattgatgagtggtttgttcaatgtggctgctttaaattgttggtcaaatcttctaggtccatttggatcttctacccattcattgaatcctttattcaaagtggtgtataaatgtctccaattcttattgttgcattgtctatttctctcttcaattctgtcagattttgctttctgtcaatttggggtttctattgttatgtgcatatatttttatatttgttatatattcctaaagtgttgactctttcattattgtgacatgcctctctttatttctagcaacactgttttttcattttaatttttttgactgacattaatacagtccctccagttctctgatgattgctgtttgcatgatatcattttccatcattttagtttcaaattacatgaaactttaaatctaaagtgtgtttgctttaaaaagtatgtaggtagattgtttttaaattaaatctggcaatctgtcttttgattggatctttatcaattcacatttaattttatcttgatatggtgtgtgaacattttctgtggcaccattttaattattttaataattgtttaattttatttttgagccatattctcaggggtcactctagggcttgcaatagatatatatcttaagttatcaaaatgacaccagatttccagtaaattccagtaaaatatgaaaactttactcttgcaaatgtcattccccacttttgtgcatatttagatactatatataatgtataatgtctatatatggtaaaaatatttttgtaattatactgtatatatatttagaaagttgatgaaaagtggagagcaagtatatatagtcatagagcttgttattatcttttttatttaccaatttttatcctatttctttctgtaggcttgttatcttacatcatttcattactccaatatagctttgttacacctgcctcctttatgctgttattaccaaatatattacattactatatgttatatggccaacaatataattatgtatacatattgttttattcagttgtttctaaagtaagttaaaagagaaaaggagaagaaaggtgcaattacattgtgttttataattactgactttatgacctttattagcactctgttttttcatgtggatttgaaatactgtttgatgccacttgctttcaactcatggaactttctttcatacaccttctaaggcacatcttttagcaatgatatctctcagctttcatatatctgggaatggtttcatttcaccttcattcatctggaatgtctttatttcacctttatttttgaaagacactttttctggatttaagaatcttggttgatagttttctttcagcattttgatattatctcactgcctctggcctcattatatctgatgagcagtaagttattattctcattggagttccttgcatgtaatgatttgtttttctcttactactttcaaaattctatcttaatattttgttcttaatattttgattataatgtgtctggatggaaatatttttgtatttatcttatttggagtttgttgatatccttaaatgtgtagaatacagtttttcaacaaatttggaaagtaactattttttcaatagtttttctttcccttttgtctcttttcttcacctagttctcccattacatttggctacttaatattttcatatatttctccaagactttgttcactgtacttacaatcaaagaactgcagactatcacaagatagctggcactacagaagacttctagtacaaccaaaccaattatttttattgccttccttattcaaaaagctcaacaaatgttcatcccagcttatgcttgcatatcttcagtgaaggaagtgactaattcttaagtatttcattttgattttatgctggtctaattttaagaaagctttatattaaggaacagtctccccttgttttgattccaagtccccttagcatcataattacccttctctctaaaagcttctgttagttataatcattttcaaaggtgaatcataatcctagaagagctgacatcagagtaaaataataggtttttatctcactgtagatgcatcaattcataaagctgaagttatatcagatattgaagaggtacaaaatacactgttcctccatagttaacgtgaggtcaattaaaagttggatgtcttcacatgaatttgctttaaatcatatatcgtttaatctgtgtttgaatagaattttttaaatggcacacttatatttgctaaaaattttatattcctgggtttagctctttcagtctaaatatttgtaattttattttttattaaatattagctcactcttctggcctcataaaatgtataatcatgttgtttgtacctaattctaatatggtaataaacagaatgatcctgagatagccccttaaaaagctaagttcaggttaacgttgaagcatttataatagttgttaagtaagattattcaactacataaaaactgaggcagggcacaatggctcatgcctgtaatcccagcactttgggaggccgaggtgagtgaatcacccgaggtgaggagtttgagaccaacctgaccaacatagtgaaaccccatctctactaaaaatacaaaattagctgggcgtgctggtgcatgcctgtaatcccagctacttggtaggctgaggctggagaatcacttgaacccgggaggcagaggtaacagtgagccaagatcatgccattgcactccagcctgggcaagaagagagaaactctgtctcgaaaaaaaaaaaaaaaaagtaaaaatgtacccataccttaatattttctattttgtcctaagattattaagaaaatctcttaaattcaaagatctctaaaaatcaagatagcctgtatattacataaataattatttgaacaccaataataatgaaaattagatttatttgacataatgtgtacttagtaatcccctatgggcttccatttcttatctattttctttctaaattctcaaaaaatattatacaatagacacattttttggtataaccacagctacttttcataatacatttcagttctatgggtatatgaggtctaataacaacaataacagcagcagcagcagctaacatttattaacaattattctgtgctagatattttactggaaaattgagtatacacatgtgctagactttatgtcaagtactatccatgcattctctcacttaattttcatagcctacttatgaaatatatgtttttattatagctatttgattataataaaagtccatcaccatggttagtatattactcaagataattaacactagatgccatggcagacaaaacctaaaatcataatggttaacaaaacaaaagttgatttcttgctcattcaaacctaaactggatggggcattcttcgtatgtagtatagctagaccatctgaaacataagctagctctagggatgctaaagcaacgaaataaagagaatggtatgcttagcccagaagtgacacacttactttgagtcagaatttattaaccagtaataaattatgtcaccccaattaaatttaaggaaagctagaaaatgtagagaaacaagtagaatactttgtaagaacaaaattattgccacaagtcaccaaagatcctttgatcccttttcgccaaacattgaacacactcctaaaaaatgacaactgaaatcccatcaagtccagaatctctacgtgtgcagtatctctcaatcaggtctggataagtttttaatccagagacttatgaattaaaagacaaatcatctgccttctgccccacccattcttatacacttaaacatacaaaagtggaagagggaaagactaaccacaagtggaagtacacactctgtgaacttctcctaccttaaggtacaggtggttcctgaattaatccctgattctgctttccgtgtggagttagttctcttgccttctgaatgtgtggagaattacggaattgcctacctcagaggctacaaaagctttttcagtgcactttttagtgctgaagatgaagaaatcaagtgtatatttaagtcttgaatgctcaaaggtattttaggctaaaattctctggtaatccttctctgttaaaattatagatatctgatctattttcttctgtgagttccatatgtggttgatcacagtaaaaattcttttggagtcatatgtagttttcatatctgcttttttttcttaatttcttcccacaattcactctctagcaatttaatggaagttactataaatctggaataatatacgggaagcccatacgcttaatctaaactgtgctgtgagtcataattttcacttaagtttgcgcccttgtctaaaagacttgttaaatttattgttttactatttgttatttagaagcagacagctttccatatgtgcaaggccctaattttggaggtcttctttttcttttattttgtcttgaaaaccagctacttttctgagctctctttttactataaggtaacttgccaaacatagtcaagtacaaccaacacacagaatcaatattccgtcttccagcttcttgccttagagacataaattagtaggcacatagtttgccttccaagttatcacggggaaattctttgctactaaataacttggactgccatcatttcagcccctgatatcaattttttcatctcctataactaatcacaaagataaggccatattttaggttttatgttatgatactaatttctgtatttaatagcataattaatcctaatttccttcacagataaaccctgtaatctcaacagtttagtacagtgaagatttctttatttctcatctaagaatcaatgtgggtcaggaggaccttgcagctatattaatggaacatatggcctctaagatctgcatagcagggaaatagaacaattctcttaatttcttttactctgaaatgatcacttttacttttgctcacagtcaagtggagagactgatcacataatttttacataactgcatgggaagctgggcaatgcaggggagcacatggaatatatggtaccggtgcttataattacaaaataaattcaaacatatctgatttaaatttcaccttcttcctctctgttctcagtagtaaaagtatttaaaatattttaaaagcaatttgaaatattacatagatacaaaaacaaaatacatttttggtttgtttgcatgtttgcttttaatttaacatctggtggcaaagatttctagtcttatatgcatgagtatgccttaattgctcatctggagtaatttagttgatattattttatatcctagactaaaattcagtcattccagcaaacaatttaggagaatggtaaaaaaaaaaagcactgttaaaattgcataaagcacaagtggattgagatcagaaaggtgacaaattggatgaatttggaagaaaaatgttggaggcagaaaatgtaatgtgtttcagtggaaaccataaaatcacctttagagtattcgtttcagatataagtggatttggagcaagacaaagtatataatgaaggtaaaataactaaagactgcataaatctgatcacaggcaggttgatacaatgaccctcaaataattaaacttttgacctttttggctgaataggaagtagcagttttgttctcagaaatatcttttatgtaacagctggcactttctggaaagtatttgaatttacttctttacaactgtatctgaaatatgaatggtccttgaaatggctatagaagattggcccattctgcagctatacttattataaagggttaaaaatcactaacagaacacacacttttaaggtttcaatttcagtcttgtatgccacatcttttcagtataaatcaagaaatttgtatgttaatttctaatactgaaaatgcttcttacagcagccgatgaaataggtattcatgaagtatagcattatttaaaaatgtctgacctacagtgttatatcatttttgtagagaaaaataaaaaaaattggataagcattataaaatgaagctaggagaaataatagctttaatttaagttaaagaagataaaagcacctattattacaaactagctaattaataaaacaagaattttggataatatttatagcaaaatcaatcagcagctaaaatgtcacatacaagtaaattaccatttatttgataatataaatgagacaacataatatctatccttagtcacaagctacaagtaggtgcatggagactttgaacttcataatcttccaaaatttccactgaaaattgtaatatcatccttacaataatatgcaagctccaagacagtaggatttcatatgccctagttgaattttgaatgcctagggctgataaaaatatttatgtagtatcactaatcattaaagaaatgcaaatcaaaaccacaatgaaatgccatctcgcattagtcagaatggttattataaaaagtcaaaaaacgacagatactgacaaggttgtggagaaaagaaaaggtttatacaccgctgatgggaatgtaaattagttcacccactatgggaagcagcttggtgacttctgaaataaaacttcagaattactatttggcctagcaattccattattggacattggacatatacccaaaggaatataaattgttctatcataaagacacatgcacacatgttcattgcagcactattctcaatagcaaagacatgtaatcaacctagatgaccatcaatggtagactgtataaaaaaacgtggtacatacacaagatggaatactatgcagcccccaaaataatgagataatgttctttgcagcaagatggatggagctggaggccattattctaagtgaactaacacaggaacagaaaatgaaataccacaggatctcacttataagtgggagctaaacatcaagtacatatggatacaaagaagggagcaacagacactgggccctactggagagtggagggaggcaagagggagaggattaaaaaaatatgtattgggcactatgcttactacctgagtaaggaaataatctgtacaccaaacccctgtgacatataatttacccatgtaataaacctgcatatgtacccctgaacttaaaatgatatatatatgtatatatataattgtgtgtatatatgtgtgtgtgtgcatgtttagtaataacttatgatttagtaaaaagaaatctaagcataataaaatacctctcaatttcaaaatctgttgaaggggcaggaggaaggagttaaactatctgtccaacaatccactcattttgtttataaaatgagggcatgtaggaagaaaagaagactgtgatgtaatctaatctccatgtcaactggaactccagaaaaaatagagaaattatatttttcaggagaaagacaccttacctattgcatgcctttagcagggtggtccgtggctaaagattatttatatatatcaatatatatatataactgattccttgtctttgctatatatacatatatatatatacacacacacacacatacacacacattatatatataactatacaaattttatagttatatatatatataggttgttaggtaaattgtttgtatgtatatataactatctattgtctatcatctatctatgtagttatatatagttatataatcttttagagacagggtctcgctgtgtcactcaggctaaagtgcaatagcatgatcatagctcactgcaacctgcaaacctcaagtgttcctcctaccttggcctcccaaaactctgagattacaggcatgagccactgtgccctgccaggattgcttctgttaaataaacacagagtctgtaaggtgtgttccctggaaaatgtcaataaactacacaaccctctggaaaataaaatgaaaatattttgtaatgtaaacacttgcctccgttggaagtaaactcataatcctcactagagactttgtttttccaagtcagaagtgcatgttctccaagggaagagaggacctagaaagctacccttgatgtcccagatgtctccttgtttcatttgagtcttttgattgtatccttgatgttattagtacagtttcatactgagataagatctttgatttgtgtcattctaatttgataagccaatcatgttaaactgacttatgaagaagaaaaagaaaggcacatatgttttgtataataataaaatatcatttagactggagcatgttcaagactgaaaggcactgttatacaccaggacaacaggcactaactcagactctctggggccaaactgggacatgtagttatagtacaaatagcatgggtccctttcattagtgtatttatctaataaatattttaaaagttttgccaactttgaaagtctaggtgagaaaatggaataatatggtcccatatgggatttgtaatactcaacaatatattaattattcaggctgatcttatattaacaatataaggattagaaaatacatagaataacatgttattttcatttaaaaattaacaaatcatatattacttttaagggtagtttgattatcaccattatatttagccacacaaatatcagtatttaagaatggtatctaaaagttggaattatggtaataggtgatatgaatagcactcaaattaatctatactctgtcagaaacattaagcatcgcatatatctcaagtaagtcttatataatgtctaatgtttaggaatagctcaaggaatgaagatacaaaagtgtgcaagatatgtaattgataataccagaaccattacttactgaggtgagcttctcttggaaattttagaggtagtataaaatcttgcatattagctaaattatgtgattcttgttcttatcaactaatttaaggaccatagatgggctttggtgatcccatgaacctcctaaaattataaataaaatgcttttgtgctcatatatatatatatattttttaattgagagattaatgtttttatcacgttcttaaatttcttcatatttgggcttgtgaacaaagaagaaaaaataatcagtgctcaggagtaatagtatctaggaaataggtctactgagagatgatccatatggtggggcaatttatgctcacatttatgctctgattatgaagagatctgtagcctagttggaagtaggtacctattagcagactgaaccattttgaaaaaaaatttaatccacagtcattcactcaaattccctttaccttagaaggcaggagtaatatctagaatttattatatccaaaattaactttgtgtatgaagttttgattattcgaatattctgaccataatgttcttttataattcatacatatatattaaattttcaaagtataaatataacaaaatattgataacactaaaaatgcttttggctcttaatttagaatttttgatactcagaaggttgatttctttctttcaatgccttgagattattgagagcataaaaagtgtaaagtttaaaatacctcaaaagtgttaaatattatcaatgtttttactcctttacttccattcactcttaaccttctccaacatggttcctatctctgctccttcgctgaatttgcttttgtcaaggccaccgttgatatctatgttccagattcaataaatactatttagttttcatattccaagacttttggccaggcaaggtggctcacgcttataatcccagcactttgggaggccgaggcaggcgattgcctgagctcaggagttcaagaccagcctgggcaacatggtgaaactccatctctacaaaaaatccaaaagatagctgtgcatggtggcttatgcctgtagtcccagctacttaggaggctgaggtggaggatcgcttgatcctggggggtcgagggtgcactgagccataatcactccactgcactcaaacttaggtgacagagtgagactgtcttaaaacaaacaaacaaacaaacaaacaaacaaacaaaataaaaagaccacacacacaaaggcttttcagctggccttcaacacagttgaacagtccattctttaaaaaaaaaaaaaaacagttttattaaattagtacatgtgtaaaatggagaactgatgaaataaagccactggcaatgaggatctaacagagtttgaccaattcatatgcaaagaagagaaaatcaaatgggataaagacaccatcatgggattaaaaaagaaagatttgaatgtttaagaattaggagaagcccttgagaaaaataagaccttcaaatgattttacaaaagtgattttatgattcttctgtgaaagataaagaaaagtttatctaatcatgacaaattttatcagaataaatgttgtaaaacaaaatcaagatcacatttaaaactaaaattttatcagcaataagacaataggcatttttattcaacaaaaatgattatgaccaaagtctgaaagaaatttaataatttataaaatttaactaatttgtaataattattctgatacttgacagatttcctgaaggaggtacaatgctgacatagccatacagtaacaaagctatcagttcaatgattcttcctaaaaaaatttctcctaattcccaacttctaccccaaatgaggttcttgatatccataaagtaaccttctgaatatgtatatttagaaaatgttgaataagatatgattttttaacattgctgtaatatttttaatgggaatagagaatacatagagaaaagtgcacaaatcacaagtgtataggtggatgaattcttccaaagcatgtaaccaacacacagatcaagaaataatattatcaaaatcctagatgcctgtctgtaatttcttccagtcactactcccctatgaagataattatcattttttagctttttatacacggattacatgtacttttttgtgtctggcttcatttgctccaagatatggatattttatctagaagtctcaacatatatttcatagacttttggatttatacttgcaaatcaacatgcccaatttctaattatattatttactcttcatcaaaatatatttattaaatataattaaaaattcatataactaacctttttgaatgagatgtcttgatgtttttgatttcatgcctagatcttttggttttaattcacataaaatagatgacacatgttttctgtgttcactggaattttttaaatcaacaggataatatatattctgtgaaaataaaataaaagcaatgacaatgataatatctcatgtgttttagagttcttcaagggttttcacatgaattacattatcatgattgattttcatttaaaacatgaaaacaaaaacctgtgaggtaggcagggttaagaaaaaaatttaaaaagctccattgtgtataattttaacaatctgtcattctactaatattgtaccttggccaatgctgtgagagagattgagggaaagagagacctgccaggaaagtgctgtgacaaaaggaacaagggaagagggaaaataaggaataaacaaagagaagcaagatagtgttccccagaaagcctgaaggaagattcagagtaataaagggaggtacaaaattatttcacagagcactaaaaggcagtaacatgggggaggaaaaggagggacaataacaggaagaaaggaagggagaaacgggaccagaattatcacacatgttaaaactacaaatgggccaggcacaggggctcacacctgtaaccctagcactttgggaggccgaggcaggtggatcacctgaggttaggagttcgagcccagcctggccaacatggcgaaaccctgtctctactaaaaatacgaaaattagccaggtgtggtggtgcatgcctgtaatcccagctactcaggaggccaaggcaggaggattacttgaacccagcaggcggacattgcagtgagccaagattgcaccattgcactccagcctgggcaacagagcgagactccgtctcagaaaaaaaaaaaaagaaaagaaaaaggacaaatggatcagctatgtgtgggaagagtagcaagtagcttcatggggaacagaggcattgtcaaatgtaaactgtataatatctgtgaactggttgggatgttttagtgacagtgttatctgttttcctcttcacagttcatccaggactgttacggagctttcatcaggttatcagggacataggctctttcaaaattcctttatcatctcttactgtatctgcatgggtactatcctcaaacttttcacatgagtgaaaatagctactagagctccaaacaccatttcagtcagaagttggaggaaaagggaaatgacaaaaggacacaggccctgtatcttaaggagcttttccagaggttcttcaaataacttctgtttaatatctcattggccccacatccggctatgaaggggagggtaaagaataacgtattttgctaggtgttttgctgcctggaatgaaatttgggcccgttaccatgacagaagaaaagagtagatattggtaggcaaccaatagtccatcagagaaaaagttcagaagcttagatgagggtatgtgtttacatattaaaaaactttctcgggatatgatactttctttggtaagaaacactgatctgacttctgaagactcacaaatatttagtttccatagatctttctgagatctttggttttgtgtatttgtttctggaacatttacatagcgcttatcatttgctattgtgaagttctttatggatattaactcatttaataatcaaaacaaccataaactgagctctttcacatggacatctcatactcaagagaatcaaaacaatatttttttcctccaaatatattagttcttagtcctagtttcagtgaatggcaccacattcatttaagaagaagaaagtcaggtaaactctctgatatgtcacagctgacagaattttgaaatagagaattcatcctcacatttcccccattacttcgacctgttcacttgttcaaacctcctttatttgatgatttagaaaagacacttggatatgtgccttggtcccctgtatttacaattttcttagtttctattatttaaattttatatgtgatattctctaatttacttatcaaaaacaatttgtctccaagcagtgactcatagggtaagggctttttaatgctcattataggtgttaagtatcatctgttcctggaataaacctgtttttatttttcatttaaaaattcttcactcaactcttacacaagacaatttctattcactctttatgtgataaaatcacctcattttgctagaaacacaaataagtacttttaagctcatacattctctttacatttaaaaatttttcaatgttgccaaggataattaaaatttaagaagtcacaataccaaaacatattgtcaaaatatgacacaattttaagtaatgctgcttctattttcatttaggccctggtttttctattagagaagtatgacaaaatacaatgtgtggcactattttgcaattccagtctgtaacaacaactctaaatactttttcaacctcaaattcttctgcaagtcctcttcaagttgcatgatcactctcgtattttcctacttctaagaattttgctctatttggaaacttctctctgtttctgcctcctaacgatgcaattcatcacatgttgaaaatcacctcaaattgcatttgaaccatagaaatgtgtcatttctttcttctatatatctcacttttatcctacccatgataaaataatgagtatgttcagtgatcctgtttccactagtacttacacctttagattcccctgaaaaaaacaagaaccccccccaaaaaaaatctgtcaaatttgagatatccaaactctatcacaaatacagttaatttataaactcatgaaacgtaaagggtcagaaattaagtagacagctagttagctccttttagaaatatattttcttcgtttctcctaattatcctttttcatgtatctggctgtcattgcttgccacattttataaaaatatttccttccatgtttttagaaaagaagaattcatgacaaagggtacatatatgacaggggaacaaatctacagaaagatgaacaaaaagtttaaagctctaaaggaactgaggcttacacaagctgcaaaagtaaagaaatgggcttttctgttatatgtaatgcaagaagggaaagagaatgtgtgcacttactgatagatctttgagctcatagagaaggaaaagttatcagaagactgggaatgatctaataacgatcttactttcaataacagaaagtatatttgattaactaccctactttagacttaacactggtcctcaataattgcagaaaatattttaaggatatttggtagcacttagtaaaggaataataatcaaggaataagttgacaataaactaattatatcaaatacaatttcatttttaacaaggtcaaaattaattcaggttcaaatatccttcgcatggtaaacctgtattcagcagtatgtttgataaaatctttcattacttttagatagagatcagaaacgttgagtgaccatgaaagactgaagattaataaaatgatgccaagctgaagggaggtatctaatgtcatgatacatggttctgttttcagctccattctggtcaacgtttatataaatgagaagtaaaatataaaagaaatgcttgctaccttttccaatgagatagtaaaaaaaacaaaatcaattaataccaaacaaaaatctaagatagtgtcaacagcctggaagtaaattaagcaaatgaagtaaaatagaaataaatattgcagttgggcaacatacgcttaatcactgggatacttggtggtgattttaaaacatgcatgataagacatattatattatatttataaaatacgttttagttaaaagtaaattagttaggaatttgttatgtgatgtgaccctaagctgtattaagcatttcgttgagaaagagagaagcaatagttttaccatattcacttctgaagaactatgtcagatcaggaaaacatatcttcagatgattttggataacctggaacatgaatagtaagcagcttacctactgaattattgtgaacgtaagccctatataaataggctatagataaatccagtatagagaaaagataaagggagattcagagtccctatttcctccactatccatcttcttcattttgaaaaataatgcagaaaaaaataattttttgatcaactcagaaatacttagaatttgttatttaacccttcttctgaaaccttatgcctaagctatcagcaaatcttggcaaggctacttccaaaatatattttaaatatgcttccttctctaaattttcagctacttctctattctacagctataattgtctatttctggtcaatcacaaatgcctcttattggactctgccttcaccatggcttttataatatacattttcatttgtcaaaatgtaaatccaatcatgtttctcttttagctttaagtcctcctactgttcaagatgctaagtcctttctacgaggtatagaacatcatcaaaatatggctcctcaccacacagccaaactcatctcatgctactgttgacttggtttattacagtcctgctatactagatttaatgcagactcttgaacaaaccccaaacaaaataagctattgcatgcctcaggtccttgtgtaagatctttcttctgcctggaacactctccttcccaaaatgtgcatggctagctccttttccttcaggacttaactttaaatattgtctcctcagaaaaaccatccataacaatcttatgagaaatagtcctcctcctattattctctatctcaacatcctacttgttttatttataacatttatcacaattttgtttgctaacgtaggttaagatttgttttgttttgttttttccctagaatctaatccacaagggcaaggacttttcttttcttttttactcaatgctgagaatgttctctgacactcaataaatactcaataattattcattaaatgctgaatgaatatagccaaagagaaatagcagaaggaatgagtggagatttagaaacttcagttcaatatgatgtaaaacaaagctccattctttggagacagtccaacaaccagaaataattttaaaagaaacgtatagcttgtattttctacaggactttgccccaataacacattcaacattctcttcttttcttcctgaattctttcacatctttttgttactccaaagcttctcactcagcaacccttcacaactcttgcatctctttataaactgtttatcacgattctctgaatttagattctctgaattttttggtgtttctatcaacttatcaatttctgaatttgtcacacacacaaaaagcataaacataaacatgtggtaagaataattatatctttagtcagatacatctatctacctgttctgttgattctatatcacacacaaaaaaaaccaaaacagcaattaaagagccatccttaggtaattcagagtgaagaagctaagaaaagataatctataataggtatagaagtgggggagacatagtatattaataaatctcatctaatcataataagaatttctcagagcattattgaaaattggaatagattatctgaggagctatagaactctccacaattgacaaattgaataagtacctggttataaaagtcagatggattatggtactagatatgtattttcccaagagagataatgatttatctttaaaaattaaggagcggtagcagtggtaaccattgcctctatcttctttctagatcaagaataaacactttacactgaactctgctgtctttcaaattcaaggtgcattttcaacccttcctagtttgagtttcccaacttagcctagttagagctctaaaaaattgtaattttgttttcacattctgaatgatacaaatcagagtgctaatccagatcttaccttttccagataatactcaaagagattatactaaaactcaaacaaaaagagtcgcctttatttgtttgaatgaaaatcgttagctctagtgtctggcagcacagcctctcattaacatagtatgcaaagccttcaccttagggggaggttaacgtgtacagcaatccatgtatggcaagtaaatagggttgtcctcaaagtgggtaaactatagagtagcacttggactctgctttcaataataagtactggctaacaagaaaaaccatggagaaaggagcatggttcaaatggtttaaaatgaagttttaccagaaatagttactaaaaagtaactctaaaaagttacttaaaaaagataacccctttaagtgactggcaggtttaactgaggtttgaataattgctactatcctgcatttgatatcaatcttactttatcttaagagagtgaactagaagtgataatacccttgatacgcaggagagaatccaaaaagaatagcctggataaataaacacaggaaacatatagtataaataaaagaaatgtgacatttctcttctacacacaacttagccaagaaatgagggcacctgaatattatattatgctgcaagtgtccagtttaagaacacatgacaaaaaagataatagaaagcttatgttccctcagttcaagaatggtctaatagtctaaggtctatctttactaagattggaggcaccaatgtgtaaattaatgatgcctactcttagctacactacagtgggcacttggtagtagcctttgtagaacccagtgaaaaagagatgttgcaaacttccatgagattttagagcaggttatagtttcaaattgaggaaaaaaacaatgctagtttgtgtattgtagtaattgatactaggtggaataagtaaaagaaaggacatggggaaatttcagaatatatagttttcattttatttgaaaatctctccaaaaatgtatttgattaatttttgtttacgtttcaatacaattctattcacaaccctatttttctagtacgtggattacattatctagtagctaacatattattagtaatgattaaaaataattctatatctttatctaaagatctcattttaaacagagtataactctcccttaaataattaatatcattgtttatagccttcaaagcattcgttgcattctactttatatcatagttatgtccattgctcacccctagtaaaaattactctctctgaggactgaggttgtggtttacttatcttgatatttccgcaccagtttgattgtattcttcaatctgttgtattatcaagtcacaaacaacaaaaaaggataataaatttgattagtttattcaacaactatgtattgaatggcagctatatccatggcataatattaaacataggcacaaagttattattagtaaatatttaaattatgtctttttcaaaatatttcataatttactgattatttccctatgtagatgtgaaaacaagaaaaaaaggcattgaaagtgagaaaaacatagtagaaagcataggctaaattcttaagctcctgattaaaatctgcattttattaaacctcatgttttaggccaattagttacgataatattttcaatttataaatctaatcattttaatgaaagagacatacgtatatgagtaatatgagtttacactgcttaagtaatttgcaattctgaaaagttcatagggtcatgtaaaatttaatgatgggcaataaaatggaattttcaagagggaaattcttttttcttaacaataaaatacatagctcaagactctatatttctaagtatatttgaacaatgtctatatttatgaaagatttagaaaaaagccacaaacggggacttgccaatattttattactgattagtttgctcttactttacctaaacaccttaagtaatccagcaatttagaatttatgtgttttaagtttgagtttgaatctgaggagggatttatattttttcatgagaaaaatgtctcctattaacaaagtagctatatatatataattatatctctaaagtaaggcatattacaatctacttgcatgtactttataaacacatattgataaattatgaaattgactcaataacaattacttgaataatattttctaaaattgaggttttatccccctgcaacttggaacaatatattcattttaggatttcagaatatttcttaagtgttacttcatgtaagtttttattacaatactgaagcctaaaatgactgtctcatatgaagtatagttatgtttcttctccgccaaatgccacatgtatctctaaaacttcagggactctttttatcaaatgatggattatataacaaggcagaaaatacacacacacaaacacacgtgcttatgtatgtacatatatatctcctgaggctcagtctcagtaaactgctatcactcacccaaggtaggcagcctgaaaattctacagcctcagtacaaatcttagtctgtttcactccacattgtattcagcatagcttgcttaataactttatgcctactgctctggtcagaaatatttcagccactgcccaaatgttaattatttacaagactccaatattccggggactggataaggtgactcaaaactgccctagttggcaaaccatttctaccaacaagcttattttaagttcttaagcaattaaggcaagtgttgtcagaatcttgtatattttatttttaaaggccttaatataaagaaatgcctgcaagtgactgtaagtctctctgggctttgtaggtgaattttgtcagcaaaacccaggcttatatggagtatctaaaaaactatcttaactagaccagagagcatcagtgtgattcaatagttaatattttccttccaagtcatgctgcctaaataagttttgagaaaattcagtgctgttgatgtataggtaagtcataaaacacaaatctttgtcatttaaagcttataccaatattgaaacacattgaaatagccaatctctcttacattgaacaaataaaaattcattctaagtaagtggtaaagaatggtgcttttattgatcttattatctttttcattaaaaaaggatgaacagcttaaaagtttttgcattagcagtctctgcaaagcaatttttatgatggtatgtttcattcaatttaagaattgtaatgttagctttcttatatgaggaaggaaataatatcatgaacattttaatgcaagttttaaagtgttaataaatgctagcttgagtgaattactaagtgtatttctcttttcaactttacacttatcttgtgtgtacagctgatatccctagtgtccaatcagagacaagttttcatcctgttgtccaatgaatgatgtgcataattccttttggcactgatgagagatgaatacacacatccagcccacttcagtgaaaattgacccataatttttttttatcctgaagaaaaatacagtaataaagtttaaagatggaaaaaatcagttaaactcttgaggtgtaccattagttaacaataatcagcaaacattacattttgcctggaggacagtgagctcaagatttgcttttaggtgctcatgaattctaataatcttggctctccaaatgatagcaagaaacctaaacatgtgaattttcacatttcaatgagctcaaaagttaaaattcaaaaggacagacatactttttaattattttcttctatctctactgtccccaaatatttttcttgtgaaacgagtgtatgcatttctgataaatatttagcagttgagaatatatatttatttcccacagaaagacaaaaagtgcagatcttatgtaaaactccaatgctgtctctctagtagtattatcaagataataccagaattctaagaattaaggggaaaatgacttggcatactgaggcagactaattgtcatatataccaagtattttacctttaatagtagtaaaaaggaatatgccgtaaaaagttgtttatccaccaaaacattttaattttctttaataacccttaagaatctactattcattaatttatctatgtgatttatttttggtctgttaatatcatcagcctatagaatttccagaataatgaatttcattataatgaccacggtactggtaacccccttactttatctatctttgaagggtattccaagttctactataacaggactgtcaagaaaatcagttttatttctatagctcataactttatgttttattctttgacttgcatcttataatgttaatgtattttctttcaatgattcccttcaatcttcccacccacatacaaatatcacaatgataagcagattctgtcagctattattttatattagggcagtagaataatgttttcacaaaatatatgaaaatgattatgtgatttataagttgtaactcaaaacaatataaatagaatttggattctgctttttaaatgcaacagatactattttaaataaataaatattttttgagtgcatcctatgtgcgtatcactatgctaagtacatggtggcaaaaaaaaaaaaaaaaataaaacacaacctgccataaaatggctaatatttttagtgtaaaaatgttcatatagaatagtcaccttaaaaggaggtcgaatataaataaatttaaataaagacataaacaaacctgaataacatcagagagagactaatttcccctaatactaaaagtgatctttactaaaagagaatgaatcttcattctggatgacatcagagactatgttattttatttaccattgcaagttgaagtgaagagggaaaagataaagaggtacaatcttggaataaattattccaaaataaattgaagtagttaccaggaaggaggttttagcctgggagcccagaatttaatttaaggcaaatgaacaaaggcttttagtgcctactttaagatagcataattgtagaaagaaggcagtgtgctggaatggaggtgaagcagagaaggacatatagtgatgctttttatgtcagacctatctgtgaaaaagactttgctctcaataattgactgattgatacataggcactaagatcaaacacagttaattctaacacacaattctaataatggaatctctcacaatatgcagccatggtttgcttctgagaaaaaagctgctggtagaaataatgctccatctctgtaatcaccctctccatccttcggagctactaaatcaacaaacagagaccccactctctttccagttctagtacctgtgacaggagctatttaagtgtcttcaggccaaaatttagaactcttgataaatttatctttgtgaacagcctaacatataatgctggtagttaggtttttacctcattttgagacttcatcacccctttctgcctttgcaatgtttcccagtttcttcaaacttgacatctgccttgagccatttcctaagcctctattctacctatccagtctttagtccgagttttcttcttaagacaatacttcagcatggtgtctgggatttgatacctgatgacagattccattaaccgacttttaatcttaacctggtccaatttcaatgttgctaaatgcttcatgacagttgctcaactctttcttgccatgtggacaatgaatagagcttacagtactcactggataccagactgattctctttttctaattcctagtgctataaccattctgtctcctgtactgtcatactagcccagtccaaattcttccttagtttaacctattgtgttttaattaatataccatcacctgtgaatctcaagataaagtgtatgtttaagttttaatatgagtaataggctaaaagctctaaaagttatcaaaagattgagctcattggaaagcatcttaaagaaactgggaacatgagttaggcagatgtaaaagagtaaataatacttaatttacattaggaaaacatgaggcaaacaggtaataatggacaaaagactaaagagaatggtgaacagacaacaaaaaacaattaaacagtaagccaaaacacccataaactcctgtaatctataatcctattatgctcttttatctaggctctaggaagttttctacactatcttgtcatctgtaacatttcaccacctacaaaactttaggctgacaggtgtaagaacttactctttactctttccttcatatcttaattacaattaaatagcaatcctaacatttggttgcttatatggaagattaaataataaatgtaacttgtttactcaaagtattttgataaatattatgcatataactccacaactccacatatggtattaaaatatatagagagaacttttattgccaaataatcattttgagtgctcaggtgaaattaaaatgttcattaacagccctatccacttgtttccacattttgtctcatacatctctatgtttaagataatttcctttccattaacacatttgccaagctaattctcacttccacagttttgatcatatagttttcttagttagcattttccttcctctgttcttctgaatagtattatttaaaattttatcttttttttttttttttttttttttttactttttggctttcatttttttcaatgatccaccacagagttggtgtttaattatataaacgtattggtctctatttcatctgtattcctctattacctcatctaaaatgctatttcataaaaaaaaatctaccctctttaattatcccattgcatgttgaggtgaaaaaggcacataagagcatagaatgtgaaatttttagctaatctttagtacttatgtaaaaacaatctgtgttgatatctgtattgatacttatatctataaatttgtgtgagtacctatctacggacctttaagtatatgagcaaaactgattttttaattataaagaccatcatatttgcattatactgtgtggccgaacagtgggataaatcagtatttctataggtaaaaaagtcatcaggctgggggccgtggctcacagctgtaatctcagcaccttgggaggctgaggcaggtggatcatgaggtcaggagttcaagaccagcctggccaatacggtgaaaccctgtctctactaaaaatacaaacattagctgggtgtgatggcgcctgtagtcccagctacttgggaggctgaggcagaagaattgcttgaacccaggaggcagaagttacagtgagtggagattgcgccactgcactccagcctcggcaacagagtgagactccatcaaacaaacaaacaaaaaaacaaaacaaaaaaaaacaattgtctctcagatatttgaatattctttccatatgtcaactctcagaaactaactctccacatagatttctatccattatgagtctaaaaattacaaacatttcgtaagttttttcagagaaaataacacaacattcatacacatgggaggaattatttgcatgttaatttctgaaatttattataatgacataaaatgcttacattttaggataatagatttaaatattaagcataaaacaataacaaactataccattgaagattcttaagattttttgtccttcagtagtagcataccttttaaataatataaattattcaatgccaaaattatatatacagacatacgtatcaataaaatagaacttagagtccaggaataaatccttcaatatagtcaattgaattctgacaacagtaccaagataattcaatagagataagaaatttttctcaacaaatggtagtgggacaagtggatatctatatgtaaaataataaagtcaaacctttacctcacaccacatgaaaattagctcatgatagattataggtctaaatataagagctaatactataaacgcttagaagaaaacatagaaaaaaaatctttgaggcctcaagtgaaagaatggtttcttagatatgacacaaaaaataaaggcaacaagaaaaaaatataaatgtaagtttaccaaaataaaaagcatctgggatttaaagaataccattgagaaagtgaaaagacaacccacataatgagaaaataactcacaaattatatatgtgataaaagatttgtatcaagaatatgtaaagaattctcacaactcaataataaaaagataatctattataaaatgatcaaaggatttaaatagacagttctccatagaagatatataaagggacaataaatacacaaaaagatgctggcatcatcaactgctaggggaatgcaaattaaaaccaccatgagattactttgtatcctgtagaacagttataatcataaagacataaaataacaagtattggttgggttttggagaaattgtaactctcatgcatttatcatgtgaatgcaaaatggtacaactgctatggaaaactgttcggcagtttctcaaaaagtcaagtgtagaattaccatatcatccagtaatttcacttttaggtatacccaagaaaactaaaaacatatattcattcagcaatttgtacatggatgtttagagcagcatagttaaaaatatccataaattagaaggaactcaacgaatgaatggaaaaacaaaatgtggcatatccatacaatggaatattattgagccataaaaaataaatgaattgttgataaatgttacaacatgtttgacatgagatttgggcagtgaaaaaaagtgtttcaacatggatgactcttgaaaacattatactaagtggaagtagccagacataaaataacatatatgcatgattccgcttatattaaatgccaagaatagacaaattaatggagagagaaaatagattaatgttcccaggggctgtagagagaatttctaatgggtatggggtttcttctggggaataatgaaaattttatttaattagtgatgatcgtttcacaaatttgtgaatatactaaaaacaactggactggacacttaaaatgttttattttaatggtatgtgaattacatctcagtaaagatgtttttaaaaatggtgaagttggcaatgtagcttcagtagtgtttctcaaaattataacaaaatgtaaacaatgtgagataccaaagataattaacataatagcaagagacctgagaaaattattataatttttcaggcaatttaggattcacattttcaaaaactgtaacactttttactatttctagtggtaactcaagaatgtaaaaagaagccaagtaaatatgaattttactatgtttttactgtttgataaaactgaagctcaaaataactaaaatgcagaaaacaacatatttatcattaattactagctataacacttccagaactttcatttaaacttggtaataggatcttatgcattttctgtctttggggatccaaatataaattatttgatggcatctacagaattataataaatcaggattcaagatagactagtcagaatggaataaaaaatctacaaaatagttttttttttaaaactgaagtgctaggaagatgagaaaactatgagagaactttaaaacttaaaaataaattataaaatcaacacaaagtacatcagatttagtatttaaaatacagctaaaaagagataatgattatcaggtcaaaagaagactgtaccagaaatacttagtaatgaaaataaaatttggagagtagagacatccataaccaggactggtaaaatataaatttggactaattctcaagtttcaaaaagccttatgaaagatttgtttaggccaggcatggtggctcacatctgtaatcccagcactttgaaaggccaatgtaggaggactgcttgagcccaggatttcaagaccagcctgggcaacaaccttgtctctaaaaaaaaagtataataataaaatttaacttagctgggtgtgggagtgtgtgcctgtattaccaactactagagaggttgaagtggaaggactgcttgagtccaggaggtcaagattggagtgagccatgaatgtgttacttcactccagcctgggcaacaaacagagtgagacactatctcaaaaagaataagtaaatacataaatcaaaataaaaaaattaaaagtcttttgaaaattaggaaagagctaccaagaaagctaggacttatcaggtcaaaatttaagagaaggcaagatcccccaaaggtaagtcctcaaagatgcttttgttctgataaaatttgcagatcaggaataactttggtggctcaaggagatcaggaatcaaaaatcaaatcccatgttcaccaaagtagaaggtcctgtccatagtgagctggaaactcacacagctacagcatgatacaagtaaacatggaataaaacaggctgtaaattaaaatgatacctgaataatccataaaatctcgagatttaaattgtgtcatggtcaaatattggtggtgattcagtttctagtggtagaaaatggaaacactatctggaggaaagtaccttcattctaaggcctaaaattttcacaattgatatttcaaatacaatgagcagtacacaagacctgaggtatcaaatgaacatgaacaaagactatagagttactctgcttattatttttcaataaagaatgaacaattttgatatatctgcaggaaagaacaaaaaattaaaatttattgattaaacgtagctaacaagaaaattagtgaactggaagagtaattgaaaaaaatttcagaaagcatcaaagagaaaccaaaaacaagtgaaattcaaagaagagaaaaagaaccatagagaatacaagcttattagtaaaaagtaacaaacatcctatagcaagatttttgacatcagtgcaacctagctttgctttaactgtctcaggcaaataaatgtcttaataattcaagtggaaagtatctattttattttataatattttattataacattctacctccattaaatactttctttacttcttgattattttctattgctttgccaattgctttccatacctactctgcagcaaagacttatatttgttctttaatattcgtttacctttgttttcataatagaatctctgatttttgtctgggcacatttctgcttaaaataatgcctacatatttcagccttccttgcagctgaatgtaatgataaaaccaaaatctagccaaagatatattgtgtggcatcatttagaaaccttacttaaaacacatctgcaagttccctcacacttttattttctatctcttcctctttcttgatggctggagtgtgcatgtgatgggtggagtaagtgcagtcattttgggtcatgaggtactatttgactggaggtcatgttcagaaaagcatgagataaaaacagtcagtcactaagtactgagtgaaatagttccataatatcagtcctagactgtatacctctggagttttacctgagaggtgaacaaacatattagtatcattttagatctttattacacatagctgaatctaatttaaactgatagcaatatggtagctggaagtgggatggtacagatgaaagaaatgtaaaacatttgacaccaccttagtacaggagattgggtgaccagtgataaggactcaagatattataggctgaagagctggtgacccttgttattatggcttcaaaacattttcactttggaaggcaggctacatgctgactgagtgtgttgtgttacagaaattttcaaacaaataccgtaattgagtgtgtcttagatgttacttgtagcttttatttaagtcttttgagagaaaaaaaaatctgggttatatctagccaggctgaaataagagatggaaatagaataaaatttttgataaggcaggtactctttgaagtctgcaagttaagcttactgagattctagtgattcagggccttgtgtaggtgaaaaaaccaacatctcgttcctcaaattgaagcggttacaataggggacttcaaagtagaaataagacttatatacaaaggtgtaaatgtctgcaggaaagatgagattaagaattttgtcttccctccaacacccattgtttcagaaagttcacctatggtcactatcgttaatttggaagagaggaaaatgagtagagaacaaaaaccagtaagtgaaagatcagaagcttcaggattataaacaatgtctaaacaagatctttctacttgcttaaggatagaaactactgacatcaaataaatcagaagcatactaagtttttgaatgaaatgtattaccaaaaaaaaaaagtctgtcctaaaaatacctgtggttcttcaatctctatagcaacccacaggcccctaaatctattaagactatgaaactccaacactcaggaggaacaaattccctaatacctaattctgatgttgccataaatatgaataaacaggtaagatgttttcacagggaaaatataggagatttttccagatgtgtttactctatttcaaaagaagagagtgtttactattcctatcagactgatttggtaactgctatgggggcagaaacaactgtgtttcccttttccaaattagagttttattataggtatgctgtttctatgccactttatatgctaggtatgtataaggtgaatattttataatttagctataggttgctagactatgagttatatcttgtctaagtgaagcagactggacatctaccaatataacgattggaattaagtttagctgcaagtagtgacttattcaatataggagtacttccatctcacatgaatatctgaatgtaagaagaccagggctggtatgaaaactgcaattttctgttatccaggatacttccaagtttccactcattcatggtctaaaatgaagttccaagccacagaatgaaggaaggcagaaagaagagacaaaatccattgccaactgtcttttggggacatttctcagaatctgccaaatacttcccttcatgacatggtttgatgagctgaataaagggctgccaaatcatctatgtcctaatcccctgaaccctgtgaatgtcaccttatatattagttgggtagggcttccatagactgactggcttaaaacatagtcttttttttctcacaggtctgaaagttggaagtccaaggtaaaggttccagctgattcagcttctgatgagggctgttactggcttgccgatgacaaccttctcactatgtcctgatatagtctttcctcagtatgtgcacatggggttgggggagggggagattcttaatcctatcaggtcaggaccccatccttatgacctcatttaaccttaattacttctttagagtccccatctccaaatatagccacacaagtttagaatttcaacgtatgaattttgaagggacacattcagctcataacactttataggcaaaaagatatttgcagatgtgattaaggatgttgagatgagttgattattgtggtgtgcctgataaaataataggggtctttgtaagagggaggcaggacattagagaggatgtatgtaagagatgagatgacagaagcaagaggttagggtgatgtgaggtaggggtcacaagccacagaatataggcagcttccagaaactagactaggcaagaaaacagattctgccctttgaaaaacatcagccatgtaaacactttgatttagtcaagtaaagccaattttagtcttctggaactataaaggaatgaatttatcccattttaagccaccaaatttgtagtaatagaaaactaatatacatgccaatacttaattgctagagaagctgagaaatgcaaattaatccagacagctaaaatttggggatgctattagagaggaagagagatatgatagatattagagggcaaacatcacttactgccacaaccagaaatgatggaattttttctgactattatagtgacataagcttttaggtttgctccctttggtagaggctttgtgttctgtttttggaaaaggtacaggcaaatgtttgaaattgtccttcaatagtcattccaatcttattctataataaaggaaactcatgttttagctgggcatttggatgatcttaatgagactttatttcttagcctcttgtagctatgagcccaatttgtggggcctaccagatataagcagagtgttgcatggcagcttctaggaactttccaaaagtaaacacaatagctgtgacctcttcttctttatttcctcttctttctggcaggttagaatgaaagcataatgactggatctggtgaaactattgtggaccacaagaggacctgcaaaatagaggccatgtatgctggagcaacaggatggaaggagtgaagaactctgagaacattatgatgcagagttgttataccagcaatgcactgtctatctcttgatttttatgtgagagaacagttgttttgtttacatcgctattagggatgattactcccaattctaactattgcattctcttccttctttattatttctctcatagaactgttcatgtaaatttttactcgtgtctctacatacatatccataacatgtataacaaaattttgtctttgaaaatgtaacattagtgaagttatttaaaggcatatgtgttgtgaactattataactaagatattgggaaggaaatttgttaaatatattattcctaaatctcataagcaacttacattaagcacaggaattctagctaatgagtaagaatgcttttttatgtagacagtatattcaatattggatacttttgtactctaaaatcatagccatatataactaaaccatggtcacatgggaacatagtaaataaaaaatgtaaaaatacatttaggtcattactgctaacttataagtttatccaaaacattcctaatctaagtgttactttacaatcatatagttatatttaaaaagaaatgataaaaattatatctgatggagatgtttagcagagggtctcaaactttttggtcagaggactcctttatttgcttcaaaattatgaggcccctaaaatcttttatttatgtgtattatattctttcaatatttaccatactagaaattcaaagtgtaaaaagtttaaagtatgcattaatttatttaaaataacaataagaaacccattttattttcatgaaattacacactattataaaacagaactatatttcaaaaaaaataactgttaagagtggaactggtctatatttttaagaatagatttagtgtctggcttaataacccagagattttcatatctgtttatatattaaatctcttattgtatcatgtcatgcagcctctggaaaaactccatgatacagtaatgggagaatgagaatcaaaaaggaaaatactgttttagtattattataaaagctatattggtatggtggatcctttaaaaagatttcaggaacctaaggtggtccctgaactacactttgagaaccactattatacagaataactacaaagataaatcttacaaaactggaccaa

SEQ ID NO: 1645 - DNA, 12740 bp, Homo sapiens
tgtttgcttattggtctacagagatattatactcaccttgagtccattttgatggtttgtatttgctagatatcattcttattttggcagataagtgccatccaacttttccatgtcatggcaaacaaagaaaatgatattatttgtttattactgaaaacaaaccaagtaacttgtggctggaagggacctgccaaaaaggtgcagaggattacggctgccctaggcttgcgctgactgctgaaccataaccccttatgggcaagactatgtggcacagtaagctagtgagaagtttttctctagactttaatatttcatagttttgtaggctagtcatctatataattttaatcttattagtaattttggttacagatcttctcattacttttctgtttttttaattatactttaagttttagggtgcatgtgcacaacgtgcaggttagttacatatgtatacatgtgccatgttggtgtgctgcacccagtaacttgtcatttaacattacatatatctccaaatgctatccctcccccctccccccaccccacaacaggccccagtgtgtgatgttccccttcctgtgtccatgtgttctcagtgttcaattcccacctatgagtgagaacatgcagtttttggttttttgtccttgcgacagtttgctgagaatgatggtttccagcttcatccatgtccctacaaaggacatgaactcatcattttttatggctgcatagtattccatggtgtatatgtgtcacggtttcttaatccagtctatcattgttggacatttgacttggttccaagtctttgctattgtgaatagtgccgcaataaacatacatgtgcatgtgtctttatagcagcatgatttataatcctttgggtatatacccagtaatgggatggctgcgtcaaatggtatttctagttctagatccctgaggaatcgccacactgacttccacaatggttgaactagtgtacagtcccatcaacagtgtaaaagtgttcctatttctccacatcctctcaggcacctgttgtttcctgactttttaatgatcgctattctaattggtgtgagatgttatctcatagttttgattcacatttctctgatggccagtgatgatgagcattttttcatgtgtcttttggctgcataaatgtcttcttttgagaagtgtctgttcatatccttcgcccactttttgatggggttgtttttttcttataaatttgttggagttccatggtactggtaccaaaacagagatatagaccaatggaacagaacagagccctcagaaataatgccgcatatctacaatcatctaatctttgacaactctgacaaaaacaagaaatggggaaaggtttccctatttaataaatggtgctgggaaaactggctagccatacgtagaaagctgaaactggatgccttccttacaccttatacaaaaattaattcaagatggattaaagacttaaatgttagacataaaaccataaaagccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacatgcaacctacagaatgggagaaaaattttgcaatctactcatctgacaaagagctaatatccagaatctacaatgaacttctcgttacttttctaaaatatttttttctggcctgggcctatttcattagtcttttgagagaataaacatttagcccccactcatttgtgggagctaaaaattaaaagcattatttcctaactctagtttttttgttcaacttctgtgttaattttccattccaacttttatttacttatttttaaatttttaatttttgtaggtacataggaggtgtatatagttatggggtacatgagatattttgatacaggcctataatgcataacaatgtcatcaggattaatggggtatccatcacctcaagcatttatcctttctttgttttacaaacaatccacacatattctttcagttattttataatgtacaattaattattcttaactatagtcactctggtgtgctattaaatactagatcttattcattacatctaactgtatttttatgcccattaactgtccccattccacccaccctactacccttcccagcttctggtaaccatcattctatctctacttccatgaattcaactgttttaattttcagctcctataaatgagtgagaataagcaaagtttgtctttctgtgtctgccttatttcacttaacataatgacttccaattccagccatgttgttgcaaatgacaggatctcattctttttctgtggctgaatagtatttcattgtgtatatgtaccacattttctttattcattcattcatttgttgatggacacttaggttactttcaaatcttggctatggtgaatattgccacaataaacataggagcacagatatatcttcaacagactgattgcctttactttgggtatgtccttagcagtgggaatgctggatcatatggtagtttttgtagatatttgaggaacatccaagctgttgtccatagtggttgtcctaatctacattcctaccaacaatgccaatgtcaaattatactacagagatatagtaaccaaaacaacatagtactgtcataaaaacagacatctacagatgtctctatatctgtgccagcatttgtttttgcctgtctctgataatagccattttaaatagggtgagatggtatctcaatgtagctttgatttatgtttttctgatgataaattatattgagcacattttcatatatatgttttccatgtatatgtcttcttttgagaagtgttcattcagaacttttgcccattttctaatcaaattattagattttttcctatagagttgtttgagctccttatatattgtagctattaattcattgtcacatggatattttgcaaatatattatcaatttctgcaggttgtctcttcattttattgtttcctttgctgtgcagaagctctttaactttatgtgatcccatttgtctaattttgtttggttgcctgtgcttgtggagtattactcaaagcttgttgcacagtccaatgtcctggagaatttccccaacgttttcttatagtagtttcatagtttgaggtattagcgttaagctgcaaatccattttgatgtgatttttctatatggtcagagatggtggtccaatatcattgctctgactgcagatacccaattttcccaacaccacttactgaagagactgtctttctccaatgcatgttcttggcacctttatcaaaaatcagttcactgtagatatatagatttggttctgagttctctattctattccattgttctatatgtctgtttttagaacagtcctatgttgttttggttactatatctctgtagtataatttgaagtcaggtaatatgattcctcctgttttgttcttcttggtcaagctgactttggctattctgggtcatttgtggttccataaaaattttaggattgttttctctatttctgtgaagaatgtcattgatattttggtagggattgcattgaatctatagattgctttgagtagtatggacattttaaaaatattaattattctaatccaggaacatatgtatttccattttttttgtatcctcttcaatttctttcatcaatgttttaagttttcattgtagagattgctcacttctttggttaagttaattcctaggtatctaattttatttctagctattgttaatgggattaatttcttgatttatttttcagattgttcactgttggcatacagaaatgctactggtttttctatgttgattttgtatcctgcaactatactgaatttattcatctgttctcaatttttttggtgggatttttgggtgttttcaaatataagattataccatctgcaaacaaagataatttgacttattcctttccaatttgaatgccctttatttctttcttttgcctgattgctctagctaggacttcaagtactatgttgaataacagtgatgaaagtggacatccttgttgtgttccagatcttagagaaaagccagttttttcctattcagtctgaatctagctgtaggtctttagtacacagcttttattttgttgaggtatgttcattctatatctagtttatttaggtttttatcataaagggatattggattgtgtcaaatgctttttcagtatcaattaaaataattatataatttttgtccttcaattctgttaatataatgcaccacattgattgatttatgtacgttgaaccatccttgcattcctgggataaattccacttggtggtgatgaatgctctttttaatgtgttgttgattttggtttgctgttattttgttgaggatttttgcatcaatgtttatcagggattctggaatgtagttttctgtttttgacctgtctttttctgattcttttatcaggataatactggccttgtagaatgagattggaagtattccttactcctctatttttgggaacagtttgaataggattggtgttagttcttctttaattgtttagtaaaactcatcagtgaagccatcaggtcctgatgttttctttgctaggagacttcctattacagcttcgatcttattacttgtttttgctctgtttaggttttggatcgtttcacggttcaatcttagtaagttgtatgtgtataaggatttattcattttttctaggttttccaatttatttgcatatagtttctcatcgtatcaactaataatctttcggatttctgtggtattgcttgtgatgtctctactatcatctctgattttgctgatttgggtcttctctctttttttcttggataatctggctaagggtttgttgattatatttatcttttaaccaccaatttttcatttcattggtcttttgtattattcacctcatttcaatttcatttatttctgctctgatctttattacgatcttgtcttctactaattttgggttccatttgcttttgcttttctagttctttaagatgcattgttaggttgtttaaagattttttaatatatctgatattggtgcttatagctataaatttacctcttagtagtgctctcactgtattttataatatttggtaggttctgcttccattatcattcgtttaaagaaatttttaaatttccttcataatctgctcattgacccactggtcattcaggagcatattgtttaatttccatgtgtttgtatagtttccaaaattcctctggttgatttctagttttattccattgtcatcagaggagacacttgatataatttcaattattaaaaaaattttaagacttgttttgttgtctaatatatggtctatccctgagaatgatctatgtgctgagaagaagcatgtgtattcagcagccactggatgaaatgctctgtaaatatctattaggtctatttggtctataatgtagtctaagtccagtgtttctttgttgattgtttttgtctgagtgatctctccaatactgaaagtggggtgctgaggtctccagctattttggttttgtggtctagctccctctttttctctaataatatttgctttatatatttgggtgctccagtgttgggtgcatatatatttaaaattgttatatccccttgctgaattgacctctgtaccattatataataaccttctttgcctccgtttatagtttttgtattgaaatgtatcatgtctggtataagtattcctgatcctttttagtttgcattggcatggaatatctttttccattccttattttcagtccatgtgtgtctttataggtgaagtgtatttcttactggtaaccaatcattgagtcttgttttttcatccattcagccactctatgcttttgattggagaggttagtctatttacattcaatgttattgttgataggtaagattttactcttgccattttgttatttgttttctagttgatttgtgatcttctcttctttctttcctgtcttccttttagtggtatgttttaatttcttggtttttgtgtgtgtatctgctgtattttttttatttgaagataccatgacccttgcaaatgatattctataactcattattttaaactgatgacttaataatgattgtataaacaaaaaaagagaattgtaataaaaattcgacactggacttcatccttctgctttttaactttttgttgcttctatttacatcttagtatgctgtctatgtcttgaaaagttgttgtagttattatttttgaatagttatcttctaggttgtttttactcaagatatgactagtttagacaccacaattacagtgttaaaatattctgtgtttttctgtgtacttactattaccactgagttttgtattatcagatgatttcttattgctcattaacttccttttctttctggttgaagtactccttttagcagttctggtaggcaagtctggtattgatgaaatccctcagtttttgtttgtatggaaaattatatcttcttcctatatgaaggatatttttactggacatactattctaggatacagctttttttccttcagcactttaaatatatcctgccattctctcctggcctaaaagttttccactgcaaagtctgttgccagatatattggagctccatgtatgtgaattgtttcttttctcttgctgctttcaggaatttttctttatctttgacttttaggtgtttgattattaaataccttgaggttggcttctttgggttaaatctctttggtgtacaatagctttcttgtacttagatattgacatctttctctaggtttgggaagttctctgtttttatctcatttttttgtctcctctgtatgttttgtgatggcatgtcttaaagctcactaattcttacttctacttcattaattcttctggtaagagaccgatttactcttcagtatctcaattgcatttttcaactccagagtttttgcttcattctttttaattattcaatatgtttgctaaattgatctcataggattctggactccatctctatgttatcttgaatatctttgagttccctcaagaaggctattttaaatcatctgtctgaaagttcacatatgtctctctcaacaggattagtccctggttcattatttaggttgtttggtgaggtcatgttttcctggatagtcttgatgcttgtgaatgtttatcagtgtctggccactgaagaattgggtatttattggactctttgcagtctgaggttgtttgtatgtgtgcttcttgggaaggtttttcagatatttaaaggaatttgggtgttgtgatctaagtttttgatctctgtagtcatatatacattagggggcaacccaagcccagtaatgctgtggctcttaaagattcatacaggtacttccacgaaattcttcttggatagttctggaagaattatctggattgcaaagcaaaaacgcttgttctcttcctactttcccctggataaacagtctctctctgtgatgagctacatatagttgaggaagggtggcataagcatccctgtggccaccaccactggaactgtgctaggtcagatctaaagccagcacagaactggatctcaaccaagtctttcagtaaccactgccttgctattttctatgttcactcgagcctgcagagctttaaaatcagcagttggtgaagccagccaggcttgttttcttttcttcagtgtggcaagttccccttggtcccaggtaggtcaagagatgccatccaagagccagcaccttgagtcagttactttaggaatctacctgtcacccaagccacaaaacaaagtccttccctacttccctcctctacccacaagcagagaagtctctccctgtaactatcaccaccccagttatgtggtgagtgagtattacctggttacctctgatgtttattcaaggacccagggctctttagttagcttgtggtaaatgctgccaggcctaggactctcccttcagtgaagtgagctcccctctggaccagagagggtacagcaatgccatctcagagccaagaccaaagcctggaatctgagacccttggtgctctactctgtttgggccaagctggtacctaatctgcaagatgaagtcaccttttctctccctccatttttcctcgagaagaaggagtccctagctatagccaccacagctggaaatgtgcagggtcacatctgaagccagtatgtctctcagtctcaaccaaggcccaccatgagtactgcctgggtaccactgctgattattcagtacctaagggatctttagctaggagataatgaatccttccaggactgggtctttctcttcaagacagtggattctcttctggcccagggtatgtctagaaatgttgtccaagagctaggtcctggaataggggcctcaggactctgcctcatgcccacttctactgtgggtgaacatgtatcaaagttgcccccccaccaaaaaaaagtcctccttacttatctctctcttctcttcaaacagaaggcagaagtctctcttggagttgcaagctatgttgtctagtgttgggtgaggggtgatgcaaaccctcccttggctgcttctctggcatctcatttggttatgctcccctgtcaactccactgactctgagccagcccagcaccaggacttgcccacagattgcagactttgtggtctagactgcctttcaagttaatgtaggcctccccagagcactttagccccgggtaaggtggtgaggcttgttagaacttaggctctgaccactgggatgagcaacttccctatggctatggctgatctcaatgcacattccatgagcactggctgagttccaccaagtgccactttccactgtgacagggcagcactaaatttcaatgcaaagttccacaattactgtgttctcactctctcccaagtgcagattctctttccacgccatgtggccactgccagagtgtgggggaagggtgatgttggcaattaaggactggctttcctaccctcttgagtggctccttcattgatatgaagataaaaccaaatatagtgatcactcacttgatttttggttcttataaatgtgattttttttgtgccgatagttcttcaatttggtgcttctgcaaggaggatgatcagtagaggtttctattcttctacggtgcgttacctctttcaatcagtatttctacttttaagaggtattgttgtttgtttttaaataaaaatctctaaaggcccacaagagaaagcaggaaagatctaaaattgacaccctaacatcacaattaaaagaactagagaagcaagagcaaacacattcaaaagatagcagaaggcaagaaataactaagatcagagcagaactgaaggagataaagacacaaaaaacccttcaaagaatcaatgaatcctggagctggttttttgaaaagatcaacaaaattgatagaccaccagcaagactaatacagaagaaaagaaagaagaatcaaatagacacaataaaatatgataatggagatattaccaccacagaaatacaaactaccatcaaagaatactataaacatctctactcaaataaactagatatctagaagaaatggataaattcctggacacatacaccctcccaagactaaaccaggaggaagctgaatccctgaatagaccaataacaggctctgaaattgaggtaataattaatagcctacagaccaaaaaaagtccaggaccagacagattcacagccgaattctactagacgtacaaggaggagctggtaccattccttctgaaaatattccaatcaatagaaaaagagggaatcctccctaactcatcctatgaggccagcatcatcctgataccaaagcctggcagagacacaacaaaaaaagagaattttagaccaatatccctgatgaacatcaatgcaaaattcctcgataaaatactggcaaaccgaatccagcagcacatcaaaaagcttatccaccatgatcaagtgggcttcaaccctgggattcaaggctggttcaacatatgcaaatcaataaatgtaatccagcatataaacagaaccaaagacaaaaaccacatgattatctcaacagatgcagaaaaggcctttgacaaaattcaacaacccttcatgctaagaactctcaataaattaggtattgatgagatgtatctcaaaataataaagagctatttatgacaaacccacagccaatatcatactgaatgggcaaaaactggaagcattccctttgaaaactggcacaagacagggatgccctctctcaccactcctatttaacatagtgttggaagttctggccaaagcaatcgggcaggagaaagaaataaagggtattcaattaggaaaagaggaagtcaaattgttcctgtttgcagatgaaatgactgtatatttagaaaaccccattgtctcagcacaaaatctccttaagctgataagcaacttcagcaaagtctcaggatacaaaatcaatgtgcaaatatcacaaacgttcttatgcaccaataacagacagagagccaaatcatgagtgaactcccattcacaactgcatcaaagagaataaaatacctaggaatccaacttacaagggatgtgaaggacctcttcaaggagaactacaaacgactgatcaatgaaataaaagaggacacaaacaaatggaagaacattccattctcacggataggatgaatcaatattgtgaaaatggccatattgcccaaggtaatttatagattcaatgccatccccatcaaactaccaatgactttcttggaaaaaactactttaaagttcatatggaaccaaaaatgagcccgcattgccaagtcaatgctaagccaaaagaacaaagctggaggcgtcgtgctacctgacttcaaactacactataaggctacagtaaccaaaagagcatggtactggtaccaaaacagagatatagaccaatggaacagaacagagccctcagaaataataccacacatctacaaccatctgatctttgacaaacctgacaaaaacaagaaatggggaaagattccctatttaataaatggtgctggggaaactggctagccatatgtagaaagctgaaactggatgccttccttataccttatacaaaaattaattcaagatggattaaagacttaaatgttagacctaaaaccataaaaaccctagaagaaaacctaggcaataccattcaggacatagacatgggcaaggacttcatgtctaaaacatcaaaagcaatggcaacaaaagccaaaattgacaaatgggatctaattaaactaaagaacttctgcacagcaaaagaaactaccatcagaatgaacaggcaacctacagaatgggagaaaaattttgcaatctactcatctgacaatgggctaatatccagaatctacaaagaacttaaacaaatttacaagaaaaaaacaaacaatcccatcaaaaagtgggcaaatatgaacagacacttctcaaaagaagacatttatgcagccaacggacacatgaaaaaatgctcatcatcactggccatcagagaaatgcaaatcaaaaacacaatgagataccacctcacaccagttagaatggcaatcattaaaaagtcaggaaacaacaggtgctggagaggatgtggagaaataggaacacttttatactgttggtggaactgtaaacaagttcaaccattgtggaagacggtgtagcgattcctcagggatctagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaggcacctggatgaagctggaaaccatcattctcagcaaactattgcaaggacgaaaaaccaaacaccgcatgttctcactcataggtgggaattgaacaatgagaacacttggacacaaaaagggaacatcacgtactggggcctgtcgtggggtggggggaagggggagggatagcattgggagatatatctaatgtaaatgacgagttaatgggtgcagcacaccagcatggcacatgtatacatatgtaacaaacctgcacattgtgcacatgtaccctagaacttaaagtataataataaaaaaaagacaaagcacataatcctaccaaaaaaaatctctacacttccttataagtatttcagc

SEQ ID NO: 1646 - DNA, 10854 bp, Homo sapiens
gcattatttcctaactctagtttttttgttcaacttctgtgttaattttccattccaacttttatttacttatttttaaatttttaatttttgtaggtacataggaggtgtatatagttatggggtacatgagatattttgatacaggcctataatgcataacaatgtcatcaggattaatggggtatccatcacctcaagcatttatcctttctttgttttacaaacaatccacacatattctttcagttattttataatgtacaattaattattcttaactatagtcactctggtgtgctattaaatactagatcttattcattacatctaactgtatttttatgcccattaactgtccccattccacccaccctactacccttcccagcttctggtaaccatcattctatctctacttccatgaattcaactgttttaattttcagctcctataaatgagtgagaataagcaaagtttgtctttctgtgtctgccttatttcacttaacataatgacttccaattccagccatgttgttgcaaatgacaggatctcattctttttctgtggctgaatagtatttcattgtgtatatgtaccacattttctttattcattcattcatttgttgatggacacttaggttactttcaaatcttggctatggtgaatattgccacaataaacataggagcacagatatatcttcaacagactgattgcctttactttgggtatgtccttagcagtgggaatgctggatcatatggtagtttttgtagatatttgaggaacatccaagctgttgtccatagtggttgtcctaatctacattcctaccaacaatgccaatgtcaaattatactacagagatatagtaaccaaaacaacatagtactgtcataaaaacagacatctacagatgtctctatatctgtgccagcatttgtttttgcctgtctctgataatagccattttaaatagggtgagatggtatctcaatgtagctttgatttatgtttttctgatgataaattatattgagcacattttcatatatatgttttccatgtatatgtcttcttttgagaagtgttcattcagaacttttgcccattttctaatcaaattattagattttttcctatagagttgtttgagctccttatatattgtagctattaattcattgtcacatggatattttgcaaatatattatcaatttctgcaggttgtctcttcattttattgtttcctttgctgtgcagaagctctttaactttatgtgatcccatttgtctaattttgtttggttgcctgtgcttgtggagtattactcaaagcttgttgcacagtccaatgtcctggagaatttccccaacgttttcttatagtagtttcatagtttgaggtattagcgttaagctgcaaatccattttgatgtgatttttctatatggtcagagatggtggtccaatatcattgctctgactgcagatacccaattttcccaacaccacttactgaagagactgtctttctccaatgcatgttcttggcacctttatcaaaaatcagttcactgtagatatatagatttggttctgagttctctattctattccattgttctatatgtctgtttttagaacagtcctatgttgttttggttactatatctctgtagtataatttgaagtcaggtaatatgattcctcctgttttgttcttcttggtcaagctgactttggctattctgggtcatttgtggttccataaaaattttaggattgttttctctatttctgtgaagaatgtcattgatattttggtagggattgcattgaatctatagattgctttgagtagtatggacattttaaaaatattaattattctaatccaggaacatatgtatttccattttttttgtatcctcttcaatttctttcatcaatgttttaagttttcattgtagagattgctcacttctttggttaagttaattcctaggtatctaattttatttctagctattgttaatgggattaatttcttgatttatttttcagattgttcactgttggcatacagaaatgctactggtttttctatgttgattttgtatcctgcaactatactgaatttattcatctgttctcaatttttttggtgggatttttgggtgttttcaaatataagattataccatctgcaaacaaagataatttgacttattcctttccaatttgaatgccctttatttctttcttttgcctgattgctctagctaggacttcaagtactatgttgaataacagtgatgaaagtggacatccttgttgtgttccagatcttagagaaaagccagttttttcctattcagtctgaatctagctgtaggtctttagtacacagcttttattttgttgaggtatgttcattctatatctagtttatttaggtttttatcataaagggatattggattgtgtcaaatgctttttcagtatcaattaaaataattatataatttttgtccttcaattctgttaatataatgcaccacattgattgatttatgtacgttgaaccatccttgcattcctgggataaattccacttggtggtgatgaatgctctttttaatgtgttgttgattttggtttgctgttattttgttgaggatttttgcatcaatgtttatcagggattctggaatgtagttttctgtttttgacctgtctttttctgattcttttatcaggataatactggccttgtagaatgagattggaagtattccttactcctctatttttgggaacagtttgaataggattggtgttagttcttctttaattgtttagtaaaactcatcagtgaagccatcaggtcctgatgttttctttgctaggagacttcctattacagcttcgatcttattacttgtttttgctctgtttaggttttggatcgtttcacggttcaatcttagtaagttgtatgtgtataaggatttattcattttttctaggttttccaatttatttgcatatagtttctcatcgtatcaactaataatctttcggatttctgtggtattgcttgtgatgtctctactatcatctctgattttgctgatttgggtcttctctctttttttcttggataatctggctaagggtttgttgattatatttatcttttaaccaccaatttttcatttcattggtcttttgtattattcacctcatttcaatttcatttatttctgctctgatctttattacgatcttgtcttctactaattttgggttccatttgcttttgcttttctagttctttaagatgcattgttaggttgtttaaagattttttaatatatctgatattggtgcttatagctataaatttacctcttagtagtgctctcactgtattttataatatttggtaggttctgcttccattatcattcgtttaaagaaatttttaaatttccttcataatctgctcattgacccactggtcattcaggagcatattgtttaatttccatgtgtttgtatagtttccaaaattcctctggttgatttctagttttattccattgtcatcagaggagacacttgatataatttcaattattaaaaaaattttaagacttgttttgttgtctaatatatggtctatccctgagaatgatctatgtgctgagaagaagcatgtgtattcagcagccactggatgaaatgctctgtaaatatctattaggtctatttggtctataatgtagtctaagtccagtgtttctttgttgattgtttttgtctgagtgatctctccaatactgaaagtggggtgctgaggtctccagctattttggttttgtggtctagctccctctttttctctaataatatttgctttatatatttgggtgctccagtgttgggtgcatatatatttaaaattgttatatccccttgctgaattgacctctgtaccattatataataaccttctttgcctccgtttatagtttttgtattgaaatgtatcatgtctggtataagtattcctgatcctttttagtttgcattggcatggaatatctttttccattccttattttcagtccatgtgtgtctttataggtgaagtgtatttcttactggtaaccaatcattgagtcttgttttttcatccattcagccactctatgcttttgattggagaggttagtctatttacattcaatgttattgttgataggtaagattttactcttgccattttgttatttgttttctagttgatttgtgatcttctcttctttctttcctgtcttccttttagtggtatgttttaatttcttggtttttgtgtgtgtatctgctgtattttttttatttgaagataccatgacccttgcaaatgatattctataactcattattttaaactgatgacttaataatgattgtataaacaaaaaaagagaattgtaataaaaattcgacactggacttcatccttctgctttttaactttttgttgcttctatttacatcttagtatgctgtctatgtcttgaaaagttgttgtagttattatttttgaatagttatcttctaggttgtttttactcaagatatgactagtttagacaccacaattacagtgttaaaatattctgtgtttttctgtgtacttactattaccactgagttttgtattatcagatgatttcttattgctcattaacttccttttctttctggttgaagtactccttttagcagttctggtaggcaagtctggtattgatgaaatccctcagtttttgtttgtatggaaaattatatcttcttcctatatgaaggatatttttactggacatactattctaggatacagctttttttccttcagcactttaaatatatcctgccattctctcctggcctaaaagttttccactgcaaagtctgttgccagatatattggagctccatgtatgtgaattgtttcttttctcttgctgctttcaggaatttttctttatctttgacttttaggtgtttgattattaaataccttgaggttggcttctttgggttaaatctctttggtgtacaatagctttcttgtacttagatattgacatctttctctaggtttgggaagttctctgtttttatctcatttttttgtctcctctgtatgttttgtgatggcatgtcttaaagctcactaattcttacttctacttcattaattcttctggtaagagaccgatttactcttcagtatctcaattgcatttttcaactccagagtttttgcttcattctttttaattattcaatatgtttgctaaattgatctcataggattctggactccatctctatgttatcttgaatatctttgagttccctcaagaaggctattttaaatcatctgtctgaaagttcacatatgtctctctcaacaggattagtccctggttcattatttaggttgtttggtgaggtcatgttttcctggatagtcttgatgcttgtgaatgtttatcagtgtctggccactgaagaattgggtatttattggactctttgcagtctgaggttgtttgtatgtgtgcttcttgggaaggtttttcagatatttaaaggaatttgggtgttgtgatctaagtttttgatctctgtagtcatatatacattagggggcaacccaagcccagtaatgctgtggctcttaaagattcatacaggtacttccacgaaattcttcttggatagttctggaagaattatctggattgcaaagcaaaaacgcttgttctcttcctactttcccctggataaacagtctctctctgtgatgagctacatatagttgaggaagggtggcataagcatccctgtggccaccaccactggaactgtgctaggtcagatctaaagccagcacagaactggatctcaaccaagtctttcagtaaccactgccttgctattttctatgttcactcgagcctgcagagctttaaaatcagcagttggtgaagccagccaggcttgttttcttttcttcagtgtggcaagttccccttggtcccaggtaggtcaagagatgccatccaagagccagcaccttgagtcagttactttaggaatctacctgtcacccaagccacaaaacaaagtccttccctacttccctcctctacccacaagcagagaagtctctccctgtaactatcaccaccccagttatgtggtgagtgagtattacctggttacctctgatgtttattcaaggacccagggctctttagttagcttgtggtaaatgctgccaggcctaggactctcccttcagtgaagtgagctcccctctggaccagagagggtacagcaatgccatctcagagccaagaccaaagcctggaatctgagacccttggtgctctactctgtttgggccaagctggtacctaatctgcaagatgaagtcaccttttctctccctccatttttcctcgagaagaaggagtccctagctatagccaccacagctggaaatgtgcagggtcacatctgaagccagtatgtctctcagtctcaaccaaggcccaccatgagtactgcctgggtaccactgctgattattcagtacctaagggatctttagctaggagataatgaatccttccaggactgggtctttctcttcaagacagtggattctcttctggcccagggtatgtctagaaatgttgtccaagagctaggtcctggaataggggcctcaggactctgcctcatgcccacttctactgtgggtgaacatgtatcaaagttgcccccccaccaaaaaaaagtcctccttacttatctctctcttctcttcaaacagaaggcagaagtctctcttggagttgcaagctatgttgtctagtgttgggtgaggggtgatgcaaaccctcccttggctgcttctctggcatctcatttggttatgctcccctgtcaactccactgactctgagccagcccagcaccaggacttgcccacagattgcagactttgtggtctagactgcctttcaagttaatgtaggcctccccagagcactttagccccgggtaaggtggtgaggcttgttagaacttaggctctgaccactgggatgagcaacttccctatggctatggctgatctcaatgcacattccatgagcactggctgagttccaccaagtgccactttccactgtgacagggcagcactaaatttcaatgcaaagttccacaattactgtgttctcactctctcccaagtgcagattctctttccacgccatgtggccactgccagagtgtgggggaagggtgatgttggcaattaaggactggctttcctaccctcttgagtggctccttcattgatatgaagataaaaccaaatatagtgatcactcacttgatttttggttcttataaatgtgattttttttgtgccgatagttcttcaatttggtgcttctgcaaggaggatgatcagtagaggtttctattcttctacggtgcgttacctctttcaatcagtatttctacttttaagaggtattgttgtttgtttttaaataaaaatctctaaaggcccacaagagaaagcaggaaagatctaaaattgacaccctaacatcacaattaaaagaactagagaagcaagagcaaacacattcaaaagatagcagaaggcaagaaataactaagatcagagcagaactgaaggagataaagacacaaaaaacccttcaaagaatcaatgaatcctggagctggttttttgaaaagatcaacaaaattgatagaccaccagcaagactaatacagaagaaaagaaagaagaatcaaatagacacaataaaatatgataatggagatattaccaccacagaaatacaaactaccatcaaagaatactataaacatctctactcaaataaactagatatctagaagaaatggataaattcctggacacatacaccctcccaagactaaaccaggaggaagctgaatccctgaatagaccaataacaggctctgaaattgaggtaataattaatagcctacagaccaaaaaaagtccaggaccagacagattcacagccgaattctactagacgtacaaggaggagctggtaccattccttctgaaaatattccaatcaatagaaaaagagggaatcctccctaactcatcctatgaggccagcatcatcctgataccaaagcctggcagagacacaacaaaaaaagagaattttagaccaatatccctgatgaacatcaatgcaaaattcctcgataaaatactggcaaaccgaatccagcagcacatcaaaaagcttatccaccatgatcaagtgggcttcaaccctgggattcaaggctggttcaacatatgcaaatcaataaatgtaatccagcatataaacagaaccaaagacaaaaaccacatgattatctcaacagatgcagaaaaggcctttgacaaaattcaacaacccttcatgctaagaactctcaataaattaggtattgatgagatgtatctcaaaataataaagagctatttatgacaaacccacagccaatatcatactgaatgggcaaaaactggaagcattccctttgaaaactggcacaagacagggatgccctctctcaccactcctatttaacatagtgttggaagttctggccaaagcaatcgggcaggagaaagaaataaagggtattcaattaggaaaagaggaagtcaaattgttcctgtttgcagatgaaatgactgtatatttagaaaaccccattgtctcagcacaaaatctccttaagctgataagcaacttcagcaaagtctcaggatacaaaatcaatgtgcaaatatcacaaacgttcttatgcaccaataacagacagagagccaaatcatgagtgaactcccattcacaactgcatcaaagagaataaaatacctaggaatccaacttacaagggatgtgaaggacctcttcaaggagaactacaaacgactgatcaatgaaataaaagaggacacaaacaaatggaagaacattccattctcacggataggatgaatcaatattgtgaaaatggccatattgcccaaggtaatttatagattcaatgccatccccatcaaactaccaatgactttcttggaaaaaactactttaaagttcatatggaaccaaaaatgagcccgcattgccaagtcaatgctaagccaaaagaacaaagctggaggcgtcgtgctacctgacttcaaactacactataaggctacagtaaccaaaagagcatggtactggtaccaaaacagagatatagaccaatggaacagaacagagccctcagaaataataccacacatctacaaccatctgatctttgacaaacctgacaaaaacaagaaatggggaaagattccctatttaataaatggtgctggggaaactggctagccatatgtagaaagctgaaactggatgccttccttataccttatacaaaaattaattcaagatggattaaagacttaaatgttagacctaaaaccataaaaaccctagaagaaaacctaggcaataccattcaggacatagacatgggcaaggacttcatgtctaaaacatcaaaagcaatggcaacaaaagccaaaattgacaaatgggatctaattaaactaaagaacttctgcacagcaaaagaaactaccatcagaatgaacaggcaacctacagaatgggagaaaaattttgcaatctactcatctgacaatgggctaatatccagaatctacaaagaacttaaacaaatttacaagaaaaaaacaaacaatcccatcaaaaagtgggcaaatatgaacagacacttctcaaaagaagacatttatgcagccaacggacacatgaaaaaatgctcatcatcactggccatcagagaaatgcaaatcaaaaacacaatgagataccacctcacaccagttagaatggcaatcattaaaaagtcaggaaacaacaggtgctggagaggatgtggagaaataggaacacttttatactgttggtggaactgtaaacaagttcaaccattgtggaagacggtgtagcgattcctcagggatctagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaggcacctggatgaagctggaaaccatcattctcagcaaactattgcaaggacgaaaaaccaaacaccgcatgttctcactcataggtgggaattgaacaatgagaacacttggacacaaaaagggaacatcacgtactggggcctgtcgtggggtggggggaagggggagggatagcattgggagatatatctaatgtaaatgacgagttaatgggtgcagcacaccagcatggcacatgtatacatatgtaacaaacctgcacattgtgcacatgtaccctagaacttaaagtataataataaaaaaaagacaaagcacataatcctaccaaaaaaaatctctacacttccttataagtatttcagc

SEQ ID NO: 1647 - DNA, 12639 bp, Homo sapiens
aaatctttttgaccttctcttatgttttcattatagtgactccattcttcatgactggttagctcttctgtgactgttccatgaaacatctaggaaagataagaaagtgctttgatttttttttccactttcaaaaatttacctgaaaacaaacaaaattttgccaagagatagcgcaagtaaaaagtgttattaaagttaaaatttaaaaaaactcattcttatagaactttctatcccaaaataacttaaatatctaacatttcaataacagccaatcagaatgttatcactgccctcaccagtgaacgaactaattagcaagaggaagacaaacttccattttcatagaatatttgaaaaattcagtgaagaaactgagataaaatcatcccttctagacaagacaactaacaacaaacaaatgaaaccatactttatataactcgtatgataatttttgttaaaatatactgttaaagaaatacactgaataataaacaagtcaggagagtgataatctttgttaaagaggctaaacaatgcagccagataaaataaaggtgctatacaggccttcaaatgttatcaacaatatttgtgtcttacagagaaaatttgttgtcaaaatatttacattcaattcaattaggaaattaggctcagaattctaatagctttaaattttgactacttaaatttatctaaaatatttggataaatggtttttaatataattttacacagtatttctcatatatgtgaattttcacttattaagagtaatttcagctttcataaaaggtagtcagtgataggtgagaagagaatgtatgagctgaagtggtctatttggaagtatgttttaagatcaacattccccaatggaagaatcgatttctacgatgtgcagataaactaaatcagtgtgattcaaatgagaataaatgtgaaaatccagatacactcttgtactctttcaagacactggttactttatatatcacaaccaaggcctaaaactagaatcctccagctctaagtgtcaatgaattaattagaaggcagattcatgggccccatctcatatctactgtatcagaatttctgggctaagggcataggaataatgttaacaggtgatcgacgaacaccttatgaaagattagcctcaactacaagtaaaccagtcttaaaaatatagagtcagatatggaatacacagatataaataaacctttacaaattaaactcatgaagctctattggtgctgggatgtaggataatatacacatcatttggacttccaaaatagaaaagatataagtctttcctcatttaaagaaagcttaaatttaaggttcctccaagtctttagaaaaataactcattttttaaagtactgaataacattccatcgcatggatgcactatggtttggtttatttatccattcacctattgaaaatgtcttggctgtttccaactttacacaattatgaataaaagtgctataaaaatttatgtgcaggtttttgtgtggatatgttttcaacttacttggataaataccaaggagtttgtttgctgaatcacataatatatttcattttgtaaaaaactgctactgtcttccaatgtggttgtaccatttggactcccaccagcaatgaatgagagattttattgctccacaacctcaccagtacataatgttgtcaatgttttgattttggtcatattaataggtgaataatggtatctcattgctttaatttgcaattccctaataatatatgatgttgagcatctttcatacatgtggcttattagccacatgtatatcttccttggtgagttatctgttcagatcttttgtccattatattttgattgtggtattgtgttattgttgagtttgagtactttgtattacttcagataccaatcctttgtcagatatgtgttttccaaagtttttttttcccattctgtggcttgccttttcattttcttaattttcatttcatttttagctcataaatgcataaaaagtccttgaaagggccgggcgcagtggctcacgcctgtaatcccagcactttgggaggctgaggcgggcggattaccaggtcaggagatcaagaccatcctggctaatacggtgaaaccccgtctctactaaaaatacaaaaaattagccggacgtggtggcgggcgcctgtggtcccagctactcgggaggctgaggcaggagaatggtgtgaacccaggagcgtgcactccagcctgggcgacagagcaagactacgtctcaaaaaaaaaagtccttgaaaaaccaacaccgatcaacatggaacctcagagatctcatttcttcacataatgctaaaggtggctttatactgttaatcatggcattagtacacaaattatatatatgtacacaaaattatatatataattatatttaatatatagctatataaatatatataaatatttttatttcaaaggatttatttctcacattgattattccatctcttaacagtctattttgaaatttctttatgaagatattatcttcttcctggcatttattttcagggattctcaacagtgctattaatcaaatatagttagtaatgtctatagattcatccaccaggaataattgtttattttaaaccttctgcattaatgctatctatatgccatttgaacatgccaatgaactactaatggtattattccaaagtggagttttttctattttccttactgatctcagatatattagagaattttccaaaatgagaggttctacacttgtgtgagacattcaaattttagctattagatgaataaccttgttagtagctttgtgacattaacaaatactgttgtaatgaacctgataaaataacattgtcccctcccaccaaaattcttaaatatgttcaaatatttttctacataaaatttgtaatatataataagggaattggtatgattggcactattgcctcacttgaaaacttcttgtaaataagacatagagtttgaggaagaaatgaaatattggttcacacaaatccaaatttgggataatgctcatgatattacttaattcaatgccttttttttccattttgtacaacagtttacttttcagtttcaatcaaaaagatgtctattagaaaaaaaattgtaagaattaagtactagtgtaattaaggatatattaaattcaaatttgagatctttttgatgttacttaatgcagtgtcttttcctccattttgttcaactgcctactttttagctttaatcaatgactattataagcaagaaaaaaaatcactaatcatcagggaaatgtaaattaaaaccttactcctgcaagaatggccataattaaaaagtcaaaaaacaatagatgctgtcgtggatgtggtgaaaagggaatactgctggtgggaatgtaaactagtataaccactatggaaaacagtatggaaattccttaaggaactaaaggtagaactaccatttgatccaaaaatcccactactgggtatctatccaaaggaaaataattcattatataaaaaagacacatgaacatacatgtttatagcagcacaactcacaattgcaaagatatggtacaaacctaagtacccatcaactaattagtggattaaaaaaatgtgagagagatatatagatatatatatataggtatatgtttacacacacacacacacacacacacacacaccatggaataccactcagccacaaaaaggaacaaaacaatgtcttctgcagcaacttggatgtagcccagaaggctattattcaaagtgaagtaactcaggaatggaaaaccaaatatcataagttctcacatataagtgtgagctaagctgtgaggatgcaaaggcctaagaatgatataatgtactttgaggactcaagggtgaaggttgggagggtcacgaggtatagaagactacatactgggtacagtgcacactgcttgggtgacaggtacactcaaatctcagaaatcatcactaaagaacctatccatgtaacaaaatagcacctgtaccccaacaactattgaaataaaaattaaaaaacaacaaaaaaagtcaaaaaataacagatgctggtgatgtggagaaaaaggaacgcttatacattgttggtgggagtgtaaattagttcaaccattgtggaagacagtgtggcaatttcccaaagacctaaaaacagaaacaacatttgacccagcaatcccattactgggtatatacctaaagcaataaaaattgttctattataaagacacatatacgtatgttcactgcaccactattcacaatagcaaacacatggaatcaacctaaatgcccataaatggtagactggataaagaaaatgtggtacatttacaccatggaatactatacaaccataaaaagaatgagatcatgtcctttacaggaacatggataaagctggaggatattatcctcagcaaaaaaatgcagggatagaaaaccaaatactgcattttctcccttatatgtggaagctaaattatgaaaacacatggacacataaaggggaacaacacactggggcctactagagggaggagagtgggaggagggagaggattaagaaaaataactaatgggcactaggcttaacacctgggtgactaaatcaattgtacaacaaattaccctgaaacaagattacctatgtatcaaacctgtacatctatccctgaacttaaagcaaaaatttaaaaaatccaaactattaagaaccctggcttcttagttaatgaaatgtgctaacctgctatcttaggatgttacacttctctctcagtgtaaccttctttggcaaattattgtctagtcattatttagactctgattctatccacacatccccaatttagtgattacatatttatatatgttattatttaatggccctgttttccactaaattatatgtaccctgtgaacagaaaacttgttttatggttaggtagtttttcaaatttttccataggacctgaactagaactgagtcaggtttcaataaatgtctctttcatacacatgtctgtcttttcctttcctcagagaaacagcaaactatggggaaggaacctgtaaaagacttctaagtacaaatgacaaagtctctcccatttcggtagaaatctattgtaaattcctttatttttaattctccacagccaataatcacttgcaaaacaacaaaaaaggtttatttttcaattatttatgtagtgtaacaaatcactccaaaatttattggcttaaaataaccatcattttgttactctgaagattctgtgtgttgactcagttgaagtaagcagttctccaactgacagtggctgaagcatcagttagttcactcctccagtgaactgctggaaggttaggttcagctggaatgctgagatgaaccagtctttctttccatactgtctcaggacctctctatgttgacctgtcctctccatgtcatctatccatgtgtgtctgaaatagggtagccagactttctacatgcttaagggctcccaaagcataaaagcagaacctgtccaaacttcctaaggcttaggttcaactgaagcgtctcctcagccacattctactggttacgacaagttcattttatttttcaagcaccctataaactaagtacagaaaaaggaaatgaaatgtaagttgttctgagattggtgatctcaagtaaattatgtatgctgtgcctcagtttccttatctgtaaaaagaagataataataacagcccatagaatttttatgaggacgaaataagtcaacctaaagggtttagaacagtgtttggcacttaatgatatggttgggctgtgtccccacccaaatctcatcttaattgtagctcccataatttccacttgctgtgggagagacccagtgggagataattgaatgatggtggcagttttctccataccgttcttgtggtagtgaataagtctcatgagagctgatggttttataaggggaaacccctttttctttgttctcattctctcttgtctgctgccatgtaagatgtgacttccaccttctaccacgattctgaggcctccccagccacatggaactgtgagtccactgagcctctttttctttataaattacccggtgttgagtgtgtctttatcagcagcatgaaaacagactaatacagtaagcactacaaaattaattgaatgcctagttccattaacaattcaagataaaatatatgcttcaaaaagtgtatcaagggacctgcagtttccagtatggcatgtaaggagcttggagtagtcactccatcctaacaacacattagaaagctgaacaaactaaaaatcaacaacttttcttagctacacaaagtaaggtcatagggtaaactgctgaccacaaaattggagcaacagacaggcagtacagaaactcatcaggaacagacacacagatgtcagggatgttggaaatatcagactgggaattgaaaacaactaggattaatatgctaatggctctaatagaaaaagtaggcaacatacaagaacaaatggataatgtaggtagagagatagatattctaagaaagaataaaaaagaaatggtagagaccaaaaacattataacagaaatgaagaatacctttgaagggctcattagtagatgggacatgactgataaaagaatctctgactttgaggatatgtcaacaaaaacattcaaaactaaaaaccaaagagaaaaaaaaagactgaaaaaaaacataacattccagaagtgtgggacttctaaatgtgtaacatacgtgtaataaaaatgccaaaaaaggaaaaatagaaaggaataaaagcagtatttaaaacaataatgaatgacaatttactctaacatcggacactaagccacagattcaagaaacagagaacatcatgtaggataaatgtaagaaaataaaaaaaaaacaacctcacacctagataattaatatacaaacttcagaaaatcaaaggtaaaaaaaaaatcttggaaaaagccaaagaatttttaaaaaatcttacttataaaggatcacagataataacgacatttgatttatcagaaaccatgcaggcagaagatagtggagtgaaatatttgaagtgttaagagaaaaaaaactcactgacctagaatttataaggggaaacccctttcacttggttctcattctctcttgtctgccgccatgtaagatatgccttccaccttctgtcatgatgctgaggcctccccagccacatggaactgtgagtccactaaacctctttttctttataaattacccagtgttgagtgtgtctttatcagcagcatgaaaacagactaatacagtaagctctacaaaattaattgaatgcctagttccattaacaattcgagataaaatatatgcttcaaaaactatatcaaggacactgtatggtgcaaaattattctttaaaagtgaaaaagaaataaattctgttagataaatattgaagtaatttgttgttggtaggcctgccttgtaagaaatgttaaaagaagttctgagagaagagaaatgatataggtcagatactcatatctatgttaagaaagagtgttgggaaaggaacaagtgaggataaaataaaaatctcttatttttcttattcttagttgaataatttgtccaaaataataatagcaactagttttattttaattcatccaacaacaacagaatatacattcttttcaagctcacatggagcattcactcaccaagacagaccacattctgggccataaaacatgccttatcaaattcaaaagaacagaagccatgcaacatcttctctcagaccacagtggaattaaactagatatcaataacaggcaaacagctggaaaattccaaaatacttgggagatttataaacacacttctaagtaacacataggtcaataaaaatttaaagatattttgaactaataaaaataaaatgtaaaatttagcaaaatttgtgggatatagtacaagcagtgcttaaaaggaaattcatagcactgaatacatatattagaaaagagcaaagatctaaaatgaatcatataagctgccatttctagaacttgaaaaagagcagcaaatttaatccaaagtaaatatgagaaaatttttctcatatttttcaagaaaattgtaattcttaattatattctcaaatattctgggaggaggggcatattttatcatcatctcattccagaagagtccataaagatctatagtctctataaaaaataaatactctactcagattatatgtaggttcttctacaatgtaaagcatctaaccattaacctgtagttcacatgtttagtgaagagtggggaggtctttccatatactcactgtggttacttttaccatgcaataataaatctcactccaaaatgtatcctttccttatctgttaggacattcagagttaatttttttccaacttttattttagaatcagggagtacatgtgcaggtttgttacaaaagtatattgcataatgctgcaatttggagtatgaatgaatttgtcacccaagaagtaagcatagcacccaacaggtagtttcttttcagcccttacctgtcatcctctctcccaattcttgtattcctctcaaataccaaatcttatccgaaatatgtgtctaaaaacatatttttcagttcctctttactgatttttgtttcatatgtattcaatattttaaaatcttctcaactggtttctttttagttgatgtgatatgaacactaaaataatttagtcttataagcagtcttccccatacactatattaatttacattcattttctctattaatattcacctctgccaacaatatgtatttgccagtatataaacaaccttaatatttttaaaaattacaaaacagaacataataatactggttattgctattaaaaggaaagattaacatgagtaataaattacagaaaaaactagtattctatattcagaatataacgtatgtgtcagttatttatattattcagctacatattctgtcgaactttccaatcattatggaaaagtggggatttttcatattttgttttaactaccacatgcagcatttcaattttgtttctcattatttatttatgttgtacatctgaaaactggaataactcaaatgaccaggccccagagcatgtcccctgaatcatatcattgcagctatgggcccatatgattctactgcctaccaagggaagctaaaaaccactacaattgatatatcctcctctaccaagttggaagccctttaccacttgttgcaaatttaaaatatgcacatagaggaggaatctagtcactttcattcattttagactttgataattttataactattttgtgaaatgtatatacacatttgtaaattatcaagttcaaataataatataatgttcaaaggcaaattaagtatagcaacacgttacagaacgtatcaagtctccaaccacagtttcaaagaaattctgcagttaaaaataaatcagtaccattatcagcaaacctttccttagtttgtatcaactaaagtaccaatttaaaaattatcctacattttaattgcactatataaaccatgtctataaaataaaatgcacatcagttatatctcatcttcacacccaactttgatggcaaacacattaagtgtaactatacaaggttataactcatgaatatttaaattaaatattaagaagtaaaaactatttattttgtatatttatttcttttccaaatgtgatacataataaatattgggaaaaaagttttcaaagaaagtctttgctgagtgtactaattacctttagacttaacacttattcactgaagctttcagatacttggaagacagatcatcattattttaagtaatatattaaaatattagatttgatggtctacatgaaagtaatttattttataagcatgaactataatattagatggaaatctgaatactagactccagaattatcacaacagctgttatctgcatataaaatcaaatcataaaaaaagaataaaaagtcttagtttttagaaaatctaattgtaaggattctaatcagtaacattttatacatattgtgattacaaactatttttagtttagaatgtctgcaacatattaagtgcatctctattaacaaaataaagaaattatattttttaaatactttttatttggataacagatttgttaagtaacgactgttttaataaagaattgccatgggccggtgcagtgactcatgcctgcataatcccagaactttgagaggccaaggcaagagaatgcttgagtccaggagtgagctatgatctgccattgcactccagcatgggtgaaaggttgtctctaaaaataaaaatcctgtctctaaaaatataaaagaattgccataattttatatcacagaaaaaatatattttaaaagttaagaaggggagagtctagtagaacagtcagactagtacatgtgtcctggaaaatgaacacagaatatagtgcatttataacttaatataaataaccttggtagcacaaaacattatattttcatggcatattctatatgttttcaaatgacatgaaaagtcattcagaacaaggaatcagaattcatttgtaattataactttttttctttaaatatattggctttttgaattttagaaggttatatacttctgttcagaaaaaaagcttttgtgagacctcatttttcaatttttatttttattccaacttggagactgcaaaagcataagcctgaaaaaactaaaaggtggtgagccagaagatggatattaaacagccaaaattaataaaaacattcacagaaaataatctgcacagaaatcacaacctcttaataaagaaattagcacgacaaatatttcttctagcccaaaacattccttggttagctttcatagaacagattttggatctcctaaaattaagccattaatacctttttcttaagtgtcataaatattgtattacattaattaaaatttaattcttgactctactaatttatattcttcaaccacttgccctctccctatccctttcccctccccgaaacctcatcctggtatttggacaaagtagattatgattacactactggggaactccatttggaaaaaaaatctacaaaaatactaagggaggaagtataataaaagttcaggggtgggagaatgtttctctgcactacagaaagttgaggggtgtgagggttcctccaacagggcatagtgagaaaaaaaatatttaagaaataaattgagaacaggctagctgagtaaataaatcgaaataaaacaaactgcaaaaagacaatttttgctttcgttgcatgtcaggaagggtaacaggaggaaacagtggttaaacagagccatgaagcacaaggactggaaacaagtacagccctagcttggcctgaccacagcatgcactacgagctccacagtatataatccaggaccctattcatttggcttcaacttcctcatataaagaaggggggaaaattaaaacattcttctctataatttccacacaacagtcatagttatatgcctgtagtaataaaaaaacagtgtaactggcattaactgtaaatgggttggaagacattttaatggggggatgaaaatgttctaaacctgtacctcaataaagttgctttaaaaaatctatctcattcttccttatggcagctcttcagatactctctactctcctcctggaaataaaaagcccaaatgcctccacagaatataatttttcaatttattatagtctagtatgttcaacatctttttaaaaatgtggaatccaaaactaaacagattatttcctgtgtgtttgatttgtgcagaattaatgggcttacagcttggctggattgatatattttactctggtaaaatgacattctgataaatacctggaaaaactctgtggcgaattctctagtataataatactctggtagcttaagatgttaaacagtcatatcacactgttttattatagtgaatatgaacttaaataaaatccctaaactttttttgcctccaacaatcaactgccacggaaatttactcctactcatatatatagtattttttaattttttttttactaaaaattaatattaatgaaaatttgagaaaagaaagaaaacagaagccatagctgataatatggtatatttatttccagcaaattttgattgcatgatatagtcatattgagaaaaaataatatccaatttctatggccatccttcccagatccaagaaatactctaatattctgtatgataccgtcctagatccaataaatactctatttaatattct

SEQ ID NO: 1648 - DNA, 5025 bp, Homo sapiens
acccaggtttatgctgaatataagaagtatacataaaataatatgaaaaagaaaggttgaaaatgaagtgacatttaaagaggctgggcgctgtgtctcacatctgcagtctgaacactttgggaggcctaaaattactgtagatgggaggattgcttgagcccaagagtttcaaatcagcctaggcaaccaagcgagaccccgtttctataaaaaatttaaaaaacttagctggccatggtggcagcctgtggtcccagttatccagaaggctgcggtgggaggatcacttgagcctgggaggtcgaggctgcagtgaaccctgatcacgccactgcactcctgcctgggtgacagactgagaccttgtctcaatttaaaacaaataaaaaaggcaactacaggaaagttaaacaacctgttcctgaataactcctgggtaaataaagaaattaaggcagaaatcaagaagttctttgaaaccaatgagaacagagagacaatgtaccagaatctctgggacacagctaaagcagtgttaagagggaagtttatagcactaaatgcccacatcgaaaagctggaaagatctcagatcaacatcctgacatcacaattaaaagaactagagaagcggctgggcgtggtgactcatgcctgtaatcccagcactttgggaggctgaggcgggtagatcacctgaggtcaggagtttgagatgagcctgaccaacatggagaaaccccatctctactaaaaatacaaaattggctgggtgtggtggcacatgcctgtaatcccagctacttgggaggccgaggtaggagaatcacttgaacccgggaggtggaggttgtggtgagctgagattgcgccattgcactccagcctgggcaagaagagtgaaactctgtctcaaaacaaacaaacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggattttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacggataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctgaaactatttcataacaattgaaaaggaggaactcctccctagctcattttatgaggccggcatcatcctgataccaaaacctggcagagacacaaaaaaagaaaatttcaggccaatatccctgatgaacatcggtgcgaaaaattctcaataaaatgctggcaaaccaaatccagcagcacatcaaaaagcttatccaccatgatcaagttggcttcatccctgggatgcaaggctgattcaacatatgcaaatcagtaaacataatccgtcatataaacagaaccagtgacgaaaaccacatgattatttcagtagatgcagaaaagaccttcgataaaattcagcatcccttcatttaaaaactctcaataaactaggtattcatcaaacatatctcaataataagagctatttatgacaaacccatagccaatatcagtgggcaaaagctggaaacattccctttgaaaactggcacaagacaaggatgccctctcccatcacttctattcaacataatattggaagttctggccagggcaatcaggcaagagaaagaaatacagggtattcagatagaaagagaggaagtcaaattgtctcttgcagatggcatgattctatatttagaaaatgccatcgtctcagccccaaaaccccttacgttgataagaaactttagcaaagtctcaggatacaaaatcaatgtgcagaaatcacaagcattcctatacgccagcaatggacaagcagagagccaaatcatgaatgaacccccattcacaattgctacaaagagaataaaatacctaggaatacagtttataagggatgtgaaggacctcttcaaggagaactacaaaccactgctcaaggaagtaagagaggacacaaacaaatggaaaaatattccatcctcgtggataggaagaaccagtatcttgaaaatggccatactgcccaaagtaatctttttttttttttttttttttttttttttgagatggagtctcgctccattgcccaggctggaatgcagtggcatgatcgtggctcactgcaacctccacttcccgggttcaagcaattctcctgcctcagcctcccgagtaggtgggactacaggcatgcaccaccatgcccagctaattttttgtatttttagtagacacagggtttcgccgtgttagccaggatggtctcgatgtcctgacctcgtgatccgcctgcctcggccttccagagtgctgggattatagatgtgagccaccactcctggctgcccaaagtaattaatagatttaatgctattcccatcaaactaccattggcattcttcacagaattagaaaaaactactttaaaattcatatggaaacaaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaactatcatcagagtgaacaggcaacctatagaattggataaaatttttgcagtctacccacctgacaaagatctaatatccagaatctacaaggaacttaagcagatttacaagaaaaataaaccatcagaaagtgggcaaaggatatgaacagacacttcgcaaaagaagacatttatgtctgtagtctcagctactcgagaggctgagacaggagaattgcttgacctgggaagtggaagttgcagtgagccaagattgcgccactgcactccagcctgggcgacagagtgagactttgtctcaaaaaaaaaaaaaaaaggacatttatgtagccaaaaaacatatgaaaaaacctcatcagttgggcgcggtggctcacgcctgtaatcccagcactttgggaagctgaggcagttgtggtggtgggggcctgtaatcccagctactcgggaggctgaggcaggagaatcgcttgaacctgagaggcagaggttgcgtgagctgagattgtgccattgcactccagccttagcaacaagagcaagactccgtctcaaaaaaaaacaaaacaaaaacagctaatcactgatcattagagaaatgcaaatcaaaaccacaatgagataccatctcatgcgagtcagaaatgacaattattaaaaagtcaagaaacaatagaagctggcaaggctgtggagacataggaatgcttttacactgttggtgggaacgtaagttagttcaaccattgtggaagacagagtggcaattcctcaaggatctagaaccagaaatatcatttgacccagcagtcctattactgggtatatacccaaaggaatataaatcattctctatagagacatatgcgtgtgtatatttattgcagtactcatagcaaagacatggaaccaacccaaatgcctatcagtgatagactacataaagagaatgtggtacatacgcaccatggaatactatgcagccatttaaagaatgagatcatgtcctttgaagggacaaggatgaagctggaagccatcatcctcagcaaactaacagaggaacagaaaaccaaacactgcatgttctcactcataagtgggagttgtacaataagaacacatggacatagggaggggaacaacatacaccggggcctgtcagggggttgggggcaaagagagggagagcattaggacaaatacctaatgcatgcagggcttaagacctagatgacagcggggtgcggtggttcatgcctgtaatccagcctgggtgacagagcaagactctgtctcaattaaaaagaaaaaaacaaaactagatgacggattgataagtgcagcaaaccaccacggcacatgtatacctatgtaacaaacctgcctgttctgcacatgtatcccggaactttaaaattttttgaaaattcaagttttcattaaaagaaaaaataaaaggtactaggcagctgggcgtggtggtgtgtgcctgtagtctctgctactccggaggctgaggtgggaggattgcttgagcccaggagtttgagactgcggtgagcagtggtcacaccactgtaccccagcctgggtgacagaccttgcctctaaaaataataatttgtttgaaaattgtagaaatttaaaggtactagacaaattgaaacaaaaa

SEQ ID NO: 1649 - DNA, 105455 bp, Homo sapiens
aaccagtagaattctgccaaattgccaatttaagccaaaaataagccttcttttttccacctatatctgagctttttctacagataagatttgggctaatggtttgcttattgtcattgaaacttctaatgtcataggaatcactgtcacaaagggcaaaactttaagtttataagactatattgtgttttctatgatttggctttcagcagttcttcagtgacatgtgaattacaaactttgttcatgtaaggatgatacatatatatttcccttttccatctgtcattaaggtgttaaaaatattaaaattttaattctgatttgtgttctacctgaggaatagtacctctttggtagaagggaggaaataagaactcttgaatagaatattaatagaatatgatagtccttaacaatgcatgcttggtcactgaaaagctgataaaaacaagaatttacctatttatacttaattttgttttttctaatacatttctttgtaattgatataaaaattaattttggaagttcctctaatttgggttttcttttgtgtgccagaacttttaaactgtgacgagtttgtttctatttatttgtacaagtattttctggagctttgaatctgatgattgcctggtaaatgtattgcggtaacacccaatttatctgtttttccttgaatgaatagtagaagattttggatgagatttttagttgtacagactttgttctcctctgatgggagtaagaaataaaagcacagctaacttacacccgtagttcaaaaacacaagagtgagcagatttttaaaacgtcatctcgttctcgtttgtaaggaaaggagtagtttacccccactttgtgactcagtgctctctgaaatatggcataagaggaaagttattcttgcatcattcatgtccaagttgtagatacagcttaatataaaatcgggcactgaagaacatcttctttctgatgaacagctaagtggaaccaggccacccagaatcttacccgcttctcagtggctcacattgattagccttctgagtatctcatgttcaaatgggaatgatcaaggttttttcattactgttgaaaagatttctgaggagcctgtgcatgtttaccaagtgttgtatacctttaggcatttaaacctgaaagaggcaattttttttttttttttttttttttttgagactgagtcttgctctgtcgcccaggctggagtgcagtggcacaatctcagcttactgcaatctctgcctcctggattcaagggattctcctgcctcagccacccaagtagctgggattacaggcctgaggcaccacacctggctaatttttctttctttctgtccgtctttttttgttttttcgagatggagtcttgctctgtcacccaggctggagtgcagtggtgcgatcttggctcagtgcaagttccgcctcccaggttcaagcgattctgctatctcagcctcctgagcagctggggttacaggtgcacaccaccacacccagctgttttctttgtatttttagcagacacagggtttcaccatgttggccaggctggtctcgaactgctgacctcaggtgatccacccgcctcggtctcccaaagtgctgggattacagaagtgagccaccatgcctggcctcccctggctaatttttgtattttttagtagagatggggttttgccatgttggccaggctggtcttgaattcctgccctcaagtgatctgcctgtctcacccggccaggaggcaagacattatacagacccagctaaacaatgtctctgagtaagatcagagggtaggagcggatctactgactttttaaaaaattttattttcttatataaaactttaaggaggagatctaattacttttcataactttgtatataagagaggatgttttttctttataaataaaagtattggagggtcttctgctgggcactggaagcaatgctcaggccatagctactgcatgtgcctccctgtgtcttttcagggactatttcattaataggtgtttttcttctgttcagtgtttacaggcattggagtttttacatgctaatcaagtgatccacagagacatcaaaagtgacaatgtacttttgggaatggaaggatctgttaagctcagtgagtaacaaatggacaattcacaatcatttattataattttctgccttttgtttaattaaaaacttttcttgaccaatgcaaggattaataatgatttaatataggaagaggtgagacctttgaaaactgagtgatcctctgagggttttaactaatcagtgccagagaaaggactcgctggataagacattacctaataattaccactagataagacattattaggtaatgtcttgtcttgtctttttgagatggaggtttgctcttgttgcccaggctggagtgcaacctccgcctcctgggttcaagcgattctcctgcctcagcctcctgagtagctgggattacaggtgtgcaccaccacacccagctaatttttgtgtttttagtaaagacggggtttctccacattggtcaggctggtctctagctactgaactcaggtatcttcccgcctcagcctcccaaagtgctgggattacaggcgtgagccaccgcggctggccatgattgcttatttttaagtaatcttaatggggaagctctcatacatttttggtgaatacacatgaaaatgaattaaacttttggatgacattttttttttctggctctgccatttactaagtgaataaccttggataagttgtctttatgcctcagtattcctatttgtaaaatgggaataattgtaataataaatgtacctttctcatagggttaccatgcggattaaatattttaattcttataaggtacttaaacagtatctggattgttttaagtactcattttagctataaatattgtttgacctaactgttactcttgtagaattctctcctgtagaatttctgaacttacataccgcagtaagtacaaggatgttctctgcaatattgtaaagaaaaaccaaaactatcttaagtgttgagcagtaagggaataattacatggattattatatttttatattctgtatagtttttaagatgagggaggccgggtgcagtggctcacgcctgtaatcccagcactttgggaggtcgaggcaggtggattgcttgagcccaggagtttgagaccagactgagcaacatggcaagactccatctctactaaaaatacaacaattagccgggcgtggtggcaggcgcctctagtcccagctactcaggaggctgaggcaggaggatggcttgagcacaggaggcagaggttgccgtgagccgaaattgctctactgcacacagcgtgggcaacagagtgaaaccctgtgacaaaaaattttaaaataaaaaattttttaaataggcagatgtactaatatggaaagatctcaagaaatggttttaccaaagtttacagagtatcctgattggtaatacaaaccaaaccgttcatagatattattcatgcatatgtacatgcataaccaacagtctaaagcttacaaacctaaattttaacagtagtcacatatgaaatggaatgggtttaacagtataagaaagaattctaaatactaatcctgacttttccactaaatgaacattgagtactacactaggcatcctgcacctccattacaggtgagattgagaagataatgctggtggcgaccttaggctctctgctgagatgatggatgtttagtgattctggcttctgtttgttttattcaaaaatagtttacagctgggtgtgatggcgcacacttgtaatcccaacactttgggaggccaaggtgggaagatccctcccatgttgcccaggagttcaagaccagcctaggcaacacagggggactctgtctctacaaaaaattttaaaaattaaacaaaattaaaagacaaagtagtttccatgacctgacctttacctgattcactgcatttagttttggtgtctacttttgctttactttttcgtagacctctttcagttttattaaattttttaggatagaatgaattattcagaataaaaggcctcctgataatttggactctgtggcaagtaaaagtaaaatgtgagagtgtgttacatcatgaaaatatttttaaactcattctggtttactttattaatgaaatctttaaaaacaagaggcctaatagtcaaaatataattaattacataatctgaagtgaactcttctgctaaaaccatccatggaagccattaactctgttttgttttgttttgtagctgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggtaagatgagttaaacaccagccttgttcaatgtttttctttgaaactcttatttagaacttgcacgtgcctggcactgtccaagaatttaaagtagaaggttgataaaacctaatctctgcccctaactctgcatctagaaatcatttgctctctgagttacaaattaatgtgttaggtgaagactttgtaggtttttagtagtaagctgtattgttttgtattttacgtaggaagtttggagcacctgtctctaaagcttctccttcttttattttttaagatgttttgagacagggtcccactctcttgcctattctagaatgcagtggcgcaatctcagctcactgcaaccgccacctcccaggttcaagcgatcctcctacttcagcctcctgagtagctgggactatgggtgcgtgccaccacacccagctgatttttgtacttttcatagagacggggtctctccatgttgggtcaggctggtctcaaattcttgacctcagttgatccactcgcctcggcttcccaaagtgctggcattacaggtgtgaacaactgcacctggccacttctcttttttttaaattaccatatgtggctcaacattatcagttattaaggaaatgtaaatcaaaacctcaacaatcagaggctgaggcaagagaattgcttgaacccaggaggtggcagttgcggtgagccaagatagcactactgcactccagcctgggcgacagggtgagactctgtctcagcaaaaaacaacaaaaaaccccaccacaacaggataacacttcacaactactagaatggctgtactcaaaaagacaattaataaatattggtgaccgggtgcggtggcttacacctgtagtcccagcactttgggaggctggggttggaagttcaagatcagcctgaccaacatggagaaaccccatctttactgaaaatacaagattagctgagcatggtggtgggtgcctgtaatcccagctacgtgggaggctgaggcaggaggatcacttgaacccaggaggcggaggttgcagtgagccgagatcatgccatcgcactccagcctggtcgacaaagcgaaactccgtctccataaataaataaataaatgttggtgagaagataaggaaactagaaatctcgttcattgcaaaatataaaatggtacatctgctttggaaaacaacttgacaattctgtgtgaagttaatacggaattaccagatgacctagcggttcctctgctgggtacagagccaagagaattaaaatcatacatccatacagaaaccttcatgcagccacagaagtggaaataattcaaacctggtgaacagtggaatattatttggtcatagaaaggaaggaagtgccaatccgtgttacagcattgaaccttgagagtactgtgctaagtgaaagaagccgaacaacagatggcagcagattctgaccgtctgtttcctgaatgcttttcatccagttgccaaagattccagtttatgtgggccgttaaagtacttctatagaggtgattagtttagaccacttttcagaatgacattaaagccctctaatgttattcattcatttagccagtattggtttgggtacctgccatgcgctgagcactattcacaatgctgtctaaaagaacccacaaaaattcctgctcttacagaacttgtcttctagtgggaaaagagaaaaacaaaataaatcagaataatgtgtcatacattgaataatggactcttgagtactgagactggcaggaaggaggttagggtgtttactttcaaaaggtgcttagagagctgggcacagtggctcacgcctgtcatcccagcattttgggaggccaaggtgggaggattgcttgagcctaggagttcaaggccagcctaggcaacatagtgagtccccatctctacaaaaaaatttaaaaattagccaagcatgttagtgtgtgcctgtagtcacagctaattggaaccatcatcctgccccagtgcgtgggtcacttgggcccaaggaagatgaggctgcagtgagctgttatcacatcactgcactccagcttgggtgacggctaggacctgtctcaaaaaaaatacaataaaaataaaatgtaaaattaaatcaaaagcgtgcatagggagggcttccctgaggtgacatttggacacaggaagtaagagcgtgatacttacctgagggaaaagcattctaagcagaaggcacagcaagtgcaaaagctctaaagcaggagcgttccttgtgtattgagagatgattctggacctcagcacagctggcgtacgctgagcaaacagcgagaggtgcggtcgatcggcgaagaaaccaggccagaccgtagtgccttatgagagctctggaaggattctggcttttactggaggccaaatggggaaactgttagagagatctgagcagagaagcaaagtggtctccttcagttttaataggatttccctggctgcgttgttgagagatccctgaggaaggcaaaggcagagcagaagaccagtcaagaggctgatgtcataattcaggcaagcagtgatgatggcctagaccagggcagtatcagtggaggtgggaaaaagtggtgtgagtctggatgtattttgaaagaagagtctacatgagagagaaaagactaacgggatctgttcccaagtaactcaactgcattcctgtacaaagctgaagagtcttacagggctgcgtctatagccaggagtacgctcaggcttcagaagaggctcgcctccagtggccttcactgtggcaaaaaggtctacttgaacctcagtgagatcggtaaaatcaccagcgccaagctcctatcagcagatccagaagctgatcaaagatgggctgatcatctgcaagcctgtgactatccattcccaggctggatccccgcaaacaaacaaacaaacaaacaaacaaaaaaaacaccttgggccgggcacggtggctcatgcttgtaatctcagcactttgggaggccgaggtgggcagatcacttgaggtcaggagttcatgaccagcctaacatgatgaaacctcgtctctactaaaaatacaaaaatgagccaggcatggtggcgtgcacctgtattcccagctactcgagaggctgaggtgggagaattgcttgaaactgggcgacagggagagattctgtcgcaaaaaaaaaaaaaaagaaaaaaacaccttggcccacaggcatatgggcataactgctaatgcacacattaccaaaaaggcagcctggatgaggaagatgagaattccaccccagctgctcagaagacactatgaatctaccgagattgaccttcacgtgtatcagagcctgtacatgaagtgaagggggacgtgttcagaaacaagcaggttcttcggaactcattccaagctgaagatagacaaggcctcaagaagcttctcattgaccaggccagggcacatggctctaagaccaggaaagcactgtagttccacggagagtgcctctgggccaagagaaaatcattaagactgtcccaggaggaagaaactaagaaataaaggtctccctctctcgtctgtacatagtggatcttggtgattacatagatccagtcattcaaatacaacaagattttatctgcctgatggggggaaaaagcatattggtaggaatacagaaatagccaggacccagcaatcacccagacatcagtcaaagtttaccagacaggcaaaggagcaggcagatgcagcccataatgagaaaaacttccaggcaactggaacggacagaagttcattaaaacaatctcacgactgcatttcagttgtaagaactttaaatgcatattgcttagtgaaagaatccagtctaaaaaggctacatattatttcaactgtagagagtaaaaatgattagtggttatggggtttggcaggggatcgggggtagagaggatgagtaggtgaagcacagggaatttttttgggcagtgaaattactttgtatgatattataatggcggacactggagagcattcatttgtcaaagcccatggaacaactaggcacggtggtgcacacctgtagtccctgctgcttgaaaggctgaagcaggaggatctcttgaccccaggagttcaaggccagcctgggcaacatatcgagaatgcattaaaaaaaaaaacaagaccataggactgtgtaatgtaatacagagtgaaccctaatgtaaactgagggctttaatttaatagaagtgtatcaatattggttcatttgtaacaaatgtcccatagtataataatgtagacaataataaaactccacattggggaggttgcgtgtgggaactctgtactatctgttcaattttctgtaaacctaaaacttctaaaaaattagtcagttaaaaataataatttaggaccagacgcagcggctcatgcctgtaataccagcactttgggaggccaaggtgggcagatcgcttgaggttaggagtttgagaccagcctggccaatgtggtgaaaccccacctctactaaaaatacaaaaattagtcaggcgtaatggtgcatgcctgtactcccagctactcgggaggctgagctgcaagaattgctggaacccgggaggcagaggttgccatgtgttgagatcatgccactgcattccagcctgggcaacagagcgagactgtgtctgaaaagaaaaataaataggccagatgcagtggctcacacctgtaatcccagcactttgggaggccaaggcgggcagatcacaaagttgggagtttaagaccagcctggccaacacagtgaaaccccgtctctactgaaaatacaaaaaattagccgggcattttggcgggcgcctataatcccagctactcggaaggctgaggcaggagaatcgcttgaactcaggaggtgaaggttgcatcgagctgagatcgtgccattgcattccagcctgggccacagagccagactccgtctcaaaaataaataataaataaataaataaataaaattcaatttatagaaatgtaaaggaaataattagaactatgtaaggattttctaaagggagttgattaaattaggaaacattcatataaggcaatatttacttaagccattacagtaattttatagatctaggtagttattagtaatgatgacctgggataatttgtttttttggtttttatttttgagacagagtcttgctgtcttgtccaggctggagttacagtggtgcaatcttggctcactgcaacctccacctcccatattcaagcagttctcctgcctcagcctcccgagtagctggaactacaggcatgtgccaccacacccagctaattgttttttttttgtatttttagtagcgatggggttttgccatgttgcccagcctggtctcgagctcctgagcccaggcaatccacttgtctcagcatcccagagtgctaggattacaggcatcagccaccatgcccagcctaatttgtttttgtttgtttgtttgtttgtttatttttgggacggagtctcgctctgtcgcccaggctggagtgcagtggcgcaatctcggctcactgcaagctctgcctcccgggttcacgtcattgtcctgcctcagcctcccgagtagctgggactacaggcgcccaccaccacgcccggctaattttttgtattttttagtagagacagggtttcaccatgttagtcaggatgctctcaatctcctgacctcgtgaccggcccgccttagcctcccaaagtactgggattacaggcgtgagccaccatgcccggccttggtttttttttgttttgttttttgttttttaagttttaacaaatctcattttttttaatgatatgtatgacttgaaaaaaatttgagaaacctaaacaggatggtcaatggtgaggttgtggttatttttaattattaacattgttttattttttaaagcaatatgggctgggcacagtggctcacacctgcaatccagcactttgggaggccgaggcaggtggatcatttgaggtcaggagttcaagaccagcctgaccaatatgatgaaaccccacctctactaaaaatacaaagattagcaggtcatggtggtatgcatctgtaatcccagctactcgggaggctgaggcaggaaagtcacttgaacccaggaggcagaggttgcagtgagccaagattgcaccactgcactccagcctgggtgacagagcaagattccgtctcaacaaaaaaaaacaaaacaaaagcaatatgtattgcatttataaccgaagaaaaaccaaaggtgaatctgatttcagaaaagtaacttaaggaaatgtaacatctaaaaataagaggaaagtatcaaatctaaatttaaatgggataatgataaccccagtttagtatttatggtgattttctttaaagaagaaagaatcccttagactttatggagtgctctgtgaccgtgttgagctatcttaagtggatcaaagatgttcttctatttttaggccttgtacctaatagcaactaatggaaccccagaacttcagaatccagagaaactttccccaatatttcgggatttcttaaatcgatgtttggaaatggatgtggaaaaaaggggttcagccaaagaattattacaggtaaatttaaaaatgatttcatttgggggaatagttgacttttttggtaaccgacagaaagctttcctagggctaataagtagatttcactactcattgatcaccagcggtatggcagctgctgcaatttagggtttcatcctaccatgctgagcaaactaccgcaaggacagaaaaccaaacactgcatgttcccactcataggtgggaattgaacaatgagaacacctggacacaggaaggggaacatcacacaccggggcctgttgtggggtggggggagtggggagggatagcattaggagatatacctaatgtaaatgatgagttaacaggtgcagcacagcaacatggcacatgtgtacatatgtaacaaacctgcacgttgtgcgcatgtaccctagaacttaaagtattaaaaaaaaaagtgagggtttcatctgctgtgaataaaattctgacaaaaccgtaatgtgcagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcactcctcagacctgtttattgctgttgtgtgtatatttgtcaaactaaaatgattctgctttcattcaactctgaaagtaatgcgttgattatgttagtcttatgaaggtattaatatgtgtttagtttattaaattatgatcgacaagtagtctttggggcttaattgaacaaaattattttgtttctaacctgatgaatggcacttatacatttatttttccccttctttctggcagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaatggtgttgtgccatcattttgaatttattacaaagctccaaagtaggaaggtttctagaaatgtgtgggcagtaaacatgaagttttccttttttttttttttttttttttttttgagacaagtctcactctttcttccaggctggagtgcagtggcgccatctcagctcactgcaacctctgcctcccaggttcaagtgattctcctgcttcggcctcctgagtagttaggggaagttttccctttctaaatcaagttcagaataattttctttatcaatgtttctctatcagacccagggaaacagttctgatttgaacacacaccttgctggagtaataaaaacctgatcagaatttctgtgttaagtgaaccaagaaaccttttagagtgcaatacgtcgtaaggcatcacttcattatgtgaattaatttggaatcttaggtaccctaacatagggaacagccacaataatggtttactatcaaaaagcataaaataaggccaggcgtggtggctcacacctgtaatcctagcactgggaggctgagactggcggattgcctgagctcaggcaggagaccagcctgggcaacatgatgaaatcccatctctactaaaatacaaaaaaaaatcagccaggtgtactggcacatgtctgtagtcccagctacttgggaggctgaggcacaagaattgtttgaacccgggaggtgaaggttgcagtgagacaagatcatgccattgcactccagcctgggtgacagagcaagactcctgtctcaaaaagaaaaaaaaaaaaaaaaaaaaaaaaaaaaaaaaaaatatatatatatatatatatattctgggtgagaaggggaggcaatgactttgaaatgtatttgttacactatatggctgtttcgtcttgttctaacatttatatttctttgaactaatagcaaatgctcaaagcattgcctaagaaaacttttaaaagcctgtggttaatttcagaagctctatctctagggcttggcgggaggatggctcgagcctgggaggcagaggttgcagtgagccaagatggtgccgctgtactccagcctgggtgacagagcaaggcccctgtctcaaaaaaaaaagagttggtaattgcctatatctctataaagagaattttatagtctcaataatcctgattatagctgttttacccatacatcttagtttggggttagggaaaaagactaaaaatgctgcatttctgggaaacaatttgttcagaaaatgacagcatttatataaacttgtgagttacgtgaagagactgctgatcttcgccgggcgcggtggctcccgcctgtaatcccagcgctttgggaggccgaggcgggcggatcacgaggtcaggagatcgagaccatcctggctaacgtggtgaaaccccgtctctactgaaaatacaaaaaattagccgggcgtggtggcaggcgcctgtagtcccagctactcgggaggctgaggctggagaatggcgtgaacccaggaggcggaggttgcagtgagccgagatcgcgccattgccctccagcctgggcgacagagcgagactccgtctcaaaaaaaaaaaaaagagactcctgatcttgaaaggaatgacgcccgtggatacgtcatctctggatagttgttagaaggtgcccgttgcattccctcgttcatccgtcccagtttgctctggagcagatgcaaacgtctcaccctcgtagtgctgtaacaggccagatagagtgacagtgccagatagagtgacagtgccatacatttctgtttttcattcttagacctgtaggtatgtacagcacagcatcatcaacgcgttgccaaaaaactattttcctccaattcttaataaactacttcactttgacttctatatttaaaatagaagtatagggccaggcgcagtggctcacacctgtaatcccagcactttgggaggccgaggtgggtgtatctatcacctgagggcaggagttttaagaccagcctggccaacatggtgaaaccccgtctctacttaaaatagaaaatgagccgggcatggtggcgggcgcctgtaatcccagctactcaagaggctgaggcaggagaatcgcttgaacccgggaggcagagattgcagtgagccaaaatcacaccattgcactacagctttttgagactccgtctcaataaaatagaagtgtaccattttcaaaacctagttgatcacggccataaaattaagtaatatctaacagtacaatccaactgtgattgctttaatatattgtcagtaaaatctttaaggagtttcaggattgaaactagaagacatcttagtcacattcaatattccttacattttagtacactttacgatttgctgctagtatctttgttgagctgtttttcagtaaactaaaaatcttaatcatttgaggttttagtatagatactgtcactgttttgttcacactcttggtgctgtaggagtgtaaatgaccatctcatttgttcatctgttcatgctctattggagcatgccgtaagactgtggtgtcattgaaagtgacctttggccatggactgttggatatgtggatcagctactttcatataacttgcattgtcagcaaatacttttccacttcccttcagccctgcgtattttaccacggataaacggtgttccattatgcgcctgctctgtcccatttccgtagtgtcttttttttatgacaaagcacagctggtcaaggtgttatcatgggtctgagtgcacgagtgtttgttgctgcacgttccccatccagtcactaagcaagacacagaactgtatgaaagcttatttttacttagtttcatcttagagtcacatttgaacttgtgagtttcttttaaatgaaactgtgtttaattttgagatttgctgctagggggaggactccttacgctttttgaagttagtaacagccctctctagtagaatgtgcacaaaaacggttaatgtgaattggtgggcttgtttctgtgctttgttttgagtgataatacaagggcctacatcatagggggttttcagggttaaattcattcatttcaaataaaatatttagaatgatgtctagcacaaagtcaacatttgataaatgtagtctcctctcattgcttttttcccctctgatattgcgggagcagatgcagaagtaacaggatgctgcacagagctatttgcacttttctcccatctctcgtatttaaaaaatggatgcattatggaaattatgctgcaaatattacacagcttttttttttttttttctaacacaggatctcactctgtcgcccaggctggagtgcagtggcacaatctcggctctctgcaatctctgcctcctggattcaagcgattctcctgcctcagcctctgagtagttgggactacaggcacgtgccattaccgcccagctaattttttgtattttaagtagaggcggggtttcaccatgttggccaggctggtgttgaactcttgacctcaagtgatccacccgcctcagcctcccaaagtactgggattacaggcgtgagccaccacgtctggctgttccacagctttacacaaagaaggcccccagtacatccctatttggtcacacagtgtgaaattgtgtattttacagtattgcatagttggcaatatgagactgtgcattgtagtttggataatcacttccctgaagggatattgcagataaaaaagtttaatttgagaattggttcttgaagtttttgtttgttgttttttgagacagagtctcactctgtcacccaggctggaacgcagtggcatgatctctgctcactgcaacctccgcctcccggattcaaacaattctcctacctcggcctcccaggtagctgagactacaggagtgagccaccacacccagctaatttctgtattttaagtagaagcaaggtttcaccttgttggccaggctggtcttgaactcctgacctcaagtgatccaccacctcagcctcccaaaatgctgggattacaggcgtgagccaccacacccagctgttacagagctttacacaaagaaggcccccagtacatccctatttggccacacattgtgaaattgtgtattttacagtattgcatagctggcaatatgagactgtgcattgtagtttggataatcactttcctgaagagagattgcaaagaaaaaaatttaattcaagaattggtttttgaagtttttgtttgtttgttgttttaaatagagacaaggtctcactatgttgcccaggctggtctcaaactcctgaactcaagtgatcctcccgcctcggcctcccaaagtgctaggattacaggtatgagcgaccacacccagccaagaattgttttatgtatctattagaaataagtttgtaaaccacaggttccaaagtgttagtacctttaatgtaacaggaagttcagtgtttgtcagtctggggttgtcctgggacaaccagggagtccagcaaccccaccagcacttgggactccacgttgtcactctatcattcttagcatgtaggcctgtatccttaatgcctgttgcaacatagatactagatggctggtgcacctccaacctcttgtccgggtgtcaagcaggagaaagagagatggcaaaaggcaacgtggaaagcacaagggagtagtgcttatatcgagagaacacaaattttcccagaaaccctcaacttctgtcccactggccagaactgtcatttggcacctcatagctgcaagagagtctagggaagagtgtttctccagataaaatgagactcgttagtgaagaaggagggatggaaatagtatataattgtgactactatagtttgagtgtgaaaattgctctattggaatttttttgtagctcttcccctactatttctacagagcactgccccgtctgttgactcctttgatactacatggttgatggggtgctcacttttagatatgagaaaaggggctagagcattaatctcttcagtgttatccaggtagaatttcagctcttctgggttaaggaactggaaacttttcaactctctaggcctcatctcagctagagagctagttttgaagaaacgtaattgcttatgaagtcataaatgcagtttaaatgtaattggcagtgttgcaagtttagtgatccatcgtgggaggagaccacaagtatctgctacaaattcctgattgagcaattgattgatttagtttagcaggagcctaggtgaccctgagcaaatagtccttcatgggtgttcctggcccctaagtgtcctctagggggtgctgctcccactgtcatgctcctcaaagatggagcctgccagaggtgaaagcccaattcctgccattgccctgctatcctcgggtttatgtcccattctggaagaactcaaatgtaacattattcaatgttacaagcagtctcactgttcagaaacatggagttcttttggttcttgagtcaaacttggtatcagcaaagctacattctcatagggagagaaaacaagtctgggtgtctccccaacttcctagtgctccagagagcctggctccctgtaataattcttattcttaaaaaaaaagtaactacataatagagaaatacattctgatttataaaatttcagccattcagacaaaagaaagcctcttcaatcccagtccaagtccccgttccaaaggaaatctcttactagtttccatcttttcagacctttctctttgcattatacctagatactggtcagttttgtagaccaagcagttcttgaaggctgcaatcaaagacaatttatgtttgtttccctctcttctaacccattttacaggggtagttcttccccattccctggatgaaatttagagcaaacacccaggcagttttaccaatgagttctaagaatattcaaagaaaaaattccaatcctgcacaaagtatttgaggatatagaaaacattccccaaattctattataaggatggagtagccatgataccaaaataattgaagaagaaaattataggataggccaggcgcagtggctcacaactataatcccagcactttgggaggctgaggcaggtggatcacctgaggtcaggagtttaagaccagcctggccaacatggtgaaactccctctctttagctgggcatggtggcatgcacctataatcccagctactcaggaggctgagacaggagaatcactttaacccaggaggtagaggttgcagtgagccgagatcgtgccgttgcactccagcctgggcaacaagagtaaaactccgtctcaaaaaaaaaaaaaaaaagtataggataatctcataaatacaaatgtgcaattattaaatatattactagcaaaccgaatctagcaatgtatgaaagaggtagtgcatcctaaacaagtaggcttatgcatgtaaaaatcaagataatttacagtattagtagattatctgggcatctcaacagattaaagagagtggctgagcccagtggttcacacctgtaatcccagcactctgagaggacaacacaggagaatcacttgaggccaggctcaagaccagcatgggcaacatagtgagaccctgtctctaaaaaacctaataaaaaaacattagccaggtatggtagcacacctatagtcctggctactctggaggctgagctaggagaatggcttgagcccaggagttcaaggttgcagtgacctgtgattgcaccattgcactccagcccacatgacagagtgacactgtctcttaaaaaaaaaaaaaaaaaagcattggctgggcacggtggctcacgcctgtaatcccagcactttaggaggccgaggtgggtggatcacctgaggtaaggagttcgagaccagcctgaccaacatggtgaaaccctgtatctactaaaaatacaaaaattagccgggcatggtggcatgtacctgtaatcccagctactcgggaggctgaagcagcagaatcacttgaacctgggaggcagaggttgcagtgagctgagacctctccattgcactccagcttcggcaaaaagagcaaaactccatctcaaaaaaaaaaaaagcatttagtaaaattcagtatcaattcatgattaaaaatatatattttagcaaattaggagtgaactttttttttccgagatagagtcttgctctgttgcccagactgcagtgcagtggcatgatctcagctcactgcaacctccgcctcccaggttcaagcaattctcctccctcagcctcccgagtagctgggattacaggtgtgagccaccacacctggctaatttttgtattcttagtagagacggggtttcaccatgttggccaggctggtcttgaactcctgacctcaggtgatccacgtgcctcggcctccgaaagttctgggattacagtgaagccactgtgccagccaggagtgaactgaatcacttgaacccgggaggctgaggttgtggtgagccgagatcacaccattgcactccagcctgggcaacaagagcgaaactccatctcaaaaaaaaaaaaaagaatttgaaagcaatggctgggcacaatgactcacggctataatcccagcactttgggaggccgaggcaggtggatcacctgaggtcaggagtttgagatcagcctggccaacatggtgaaacctggtctctactaaaaatacaaaattacccgggcgtggtggtgggcacctgtaatcctggaggctgaggcaggagaatcacttgaacctgggaggtggaggttttagtgagccgagatcacgccactgcactccagactgggcaacagagtgagacttggtctcgaaaaaaaaaaaaaaaaaaggaattggaaagcaagataaaatctcattattttcagataaggttgatatgataaactattaaaattaagaaatttagcaagtttgctgtatgcaaaatcagtgtgcaagagtctattatattgctaagcactagcaacaaatagaacacataatcttaaaaatctaccatttataacagatcaaaaatacaaagtacctagaaatggtcactcctgtaatcccagcactttggatcacctgaggtcaggagttccagaccagcctggccaacatggtgaaaccccatctctacaaaaatacaaaaattagttgggcatggtggcgtgcgcctgtaatcccagctactcaggaggctgaggcaggagaattgcttgaacccaggaggcagaggttgcagtgagccgagatcgcaccattgcactccagcctggggtgatggagtgagactctgtctcaaaaaataaataaataaacaaaaagggaggattttactgaaagattttaaatgttggattggaaactattttatggatagttgaaattgcacttcaaaagagaaacaatttaattcaatttaagccagataaatgaaacattggttcaaagtcagaaatacatagtcctctaaattttagtataaagagacactttacagaagccataaagtagcctgtagaggccagcaccggggcttatgcctgtaatcccagcactgtgggaggctgaggtgggtggatcacctgaggtcaggagttcaagaccagcctgggcaacatggtgaaaccctgtttctactaaaaatacaaaattagccgggtgtggtggcgcactcctatagtcccagctacttgggaggcttaggcaggagaatcgcttgaacccaggaggtggaagttgcagtgagctgagatcatgccattgcactccagcctgggcacaaagagtgaaactccatctcaaaataataataataataataataataataataataataatattcaaaaaggagaatagttgggaagcctataaatttcagcctatcctaattcagggatcctgcttctaggaggaagaaaaaaaggcatccaatagagatgaatgaacgttgtataccccctttgcctccttttcaggataatttagtgcaaactttaatactcgccattcagatgctcttcagtcataactcctaaacatgctgagggcctgttgtgtgtctgaattagtggatagggaaatgaggcacaaaaggcaattttgaagactggcctctttcagaattgcagagtttggtggactttatttttttctttttttggggggtggggggcgcaatctcactctgtcacccaggctggagtgcagtggtgtaatcggctcactgcaagctccgcctcccaggttcaagcgattctcctgcctcagcctccccagtagctggactacaggcgcccaccaccatgcctggctaatttttgtattttcagtagagacgtttcagcatattggccaggctggtcttggactcctgaccttgtgatccgtccgccacagcctcccaaagtgctgggattacaggtgtgagcccctgcacctggcctttggtagactttatattgaggagcttttgtggctgagtaaactctggacttttggaaggagaagaggtagaaaggtgttcatggaaagggacccaatcccccaggagagggttcttggacctcatgcaagaaataattccaggggagtccacggagtaaactgaaagcaagtttattaagaaagtaaaggaatagggccgggcggggtggctcacacctgtaatcccagcactttgggaggccgaggcaggcggatcaccaggtcaagagatcgagaccatcctgccaacatggtgaaaccccatctttactaaaaatacaaaaattagctgggagtgttggcatgcgcctgtaatcccagctactcgggaggctgaggtaggagaatcacttaaacccgggagcagaggttgcagggagccgagactgtgccattgagctcctcctgcctgggccacaagagcaaaactccgtctcaaaaaaaaaggaaaagaaaggaatagagcacgtctgctccataggcagcgcggcagcttgggctgcttgactgaatatacttacagttatgctaaacaaggggtggattgttcatgagttttccaggaagggggtgagcaattcccggaactgaggattcctcccctttttagaccatacagtgtaatttcctgacgttgccatgtcatttgtaaactgtcatggtgctggcgggagtgtccttcagcagctaatgcattataattagcgtctaatgaacagtgaggaccaccagaggtcacctcattgccgtcttggttttggtgggttttggctggcttggtaacacatcttgttttatcagcagggtctttatgacctgtatcttgtgctgacctccaggcctcagccttattttaaccagtccttattcaagatggagtcactccggttcaaacacctctgacaaagggataaagaaaaacgtggtctgcagattgttgcaaatgaacctaagccaggtttgatcatgcctcatttttgtttggttgtttttttcctttttttttttttttttgagacagggtttcacactgtcactcgggctggagtgcagtggtgcgatctcagctcactgtaaactccacctcccaggctcaagtgatcctaacacctcagcctctcaagtagggactacagccaccacacccggctaatttttgtgtttttttgtagacgggtttcaccatgtgacccaggctggtcttgaacccctagcctcaagtgatccaccgcttcaaccttctaaagtgcttggattacaggtgtgagccacctcacccggacatgcttaggttgtttctgtaaagttatagctacctatggagtttgaggtggtgagggttaactaacttctgacaacccccctgccagattataatgaaagcaagtcgcagaccaaatcttgtcacacacctgaaagctcatttaagcaaacatttgtcagcaaaagtgtttgttcagcctatcctgtagctcactataatccatgctctctgtcccaaatgctctgtccacaactttgcatgaaaagttcacttgaggcagagagggaaacgtgccaggggccaggattctgttacccttaaagatggcatcatgtaaccagacatcctcttaactagtggctggtcacaggattatgtaacgatggagccctgagggccattcctaaggggtcgcgttgctgacctcactagattcttacaccttgtttatgcaaaggcagcaggagtctctcaaataactttagccaatggaaggatcccgaacacctttcatttcactgatgagagcccactgatgacctcattaccaattaacaagcaactcagttcatcaggaaacagccatttctttttccatttatttatttatttatcgagacagtgtctagctctgctgcctaggctggagggcagtggtgtgatcatggctcactatagctttgacctcctgggctcaagcaatccttccagttcagcttcctgagtaactgggagcagagatgctcgccactacagctggctactttttttattttttgtacggatggggtctcactatgttgcccaggcttgtgactgcacaatgggttccccttgcccgttgcctaggcagaactgatacctcacgacaggggaactgcagtacagaaagagtaattcacgcagagccggctgtacaggagatcgcggttttattattattcaaatcagtctctccaggcattgggggatcagtgtttttaaggataatttggtgggtgggggaaggccagtgagagagtgttgattggttgggccggagaggaaatcatgggaaattgaagctgtcttcttgcgctgagtcagttcctgggtcggggccacaagatcagatgagccagtttatccatctgggtggtgccagctgatccatcaagtgtggagtctgcaaagtatctcaagcgctgatcttaggagcagtgtagggagggtcagaatcttgtagcctccagctgcatggctcctaaaccatcatttctaatcttgtgactaatgttagtctagtcccccggcaagaaggaggtctgctttgggaaagggctgttaccgtctttgttttaaactataaattaagtttccccccaagttagttcagcctacgcccaggaatgaacaagggcagcttggaggttagacgcaagatggagtcggttaggtcggatctctttcactgactcagttacaattttgcaatagcggtttcaggctgatctcaaactcctaggctcaagtgatcctcccgcctcggcctcccaaagtgttgggattacaggtgtgaacccccacacccagccaaaaaatctatttctgatcatcactcagcttgttaactgagcctcaggcgttgattgagatgtagataatagaaatgcttgcagtactgcactccagtctggaacaacagagcaagaccctatctcttaaaaaaaaaaaaaaagtgccagtagtagctgcctctagtgtgtaagtaacctttctgactagacactggctacccttatgtgtgaattttctttctttcttttttttttttgagacggagttttgctcttgttgcccaggctggagtgcaatggtgtgatcttggctcaccacaacctctgcttcccaggttcaggcaattctcctgcctcagcctcctcaaggctcacttgaacccgagtagctgggattacaggcatgccggctaattttgtacttttagtagagatggggtttctccatgttggtcaggctggtctcaaactcctgacctcagatgatccacctgcctcggcctcccaaagtgctggaattccaggtgtgagccaccgtgcccggccttcttcttctttttttttttttaagacagagtctcgctctgttgcccaggctggagtgcagtgacacaatctcagctcactgcaacctctgcctcccaggttcaagcaatttccagcgaatttttgtatttttggtagagacagggtttcactatgttggccaggctggtctcaaactcctgacctcaagtgacccagccaccttggcctcccaaagtgttaggattagaggcgcgagccactgcgcccggcctgaattttctaataaaacaatgcacgccatctttgctaaaatcttttaaagtaaattgcaggcatcataatagaagttggttcttaatatttgtagtttaactgcttattagcagtaatttgtagttgcttgtaattttactaaggtaggaatttaattttgtgacctagaagattgatgggtaggaaggaggatcacttggcttagtaaatgaagttagccagtcactcttcatccaaactttcttcttggcatttaagcactaattcccattaatgttcaacttaaattttcagttgaactttagtgattttttgggggggaacattatgttatttagggctatttgggaatttatgatggtatcaggatgtcacaggtttattgtgccataaaattttgcctatggcagactgtgcctccagtcttagtcccagaagttaagtcaggtgtctttacctctaagattccagtttaaaaaagaaagaaaaaataaataagatacaatacaggccgggcgcagtggctcacacctgtaataccagcactttgggaggccgaggcaggatgatcacaaggtcaggagatcgagaccatcctgactaacacggtgaaaccctgtctctactaaaaatacaaaaatattagttgggcgtggtggcgggcgcctgtagtcccagctactcaggaggctgaggcaggagaatggtgtgaacctgggaagcagagcttgcagtaagctgagatcacaccgctgcactccagcctgggcaacagggcgagactccgtctcaaaaaaaaaaaaagatacaatacagttccaatttagagctgggcattgtggttcacacctgtaatcccagctacttgggaggccgaggcaggaagggaggattgcttacacccaagagttagagaccaatgtaagcaacaaattgagatgcctgtctctaacgacaacaaaaaaatccagttcagtatggctaaattatacagtccatgtcctgtgatgcttacatgagttcttggggtcacgacattagccccattaaatgttccacaaggccatgagcattttttcgaagacaaaatattttaaggactagagtctttaaaggatttttggctctgtcagtctcacgctgtcacccaggctggactgcaggggcacaatctcggctcactgcaacctccgccttccgggttcaagtgattctcctgcctcagcctcccgagtagctgggattacaggcacctgccaccatgcccagctaactgttttttagtagagacggggtttcaccacattgaccaggttggtgtggaactcctgacctcaagttatcctcctacctcggcctcccaaagcgctgggattacagatgtgagccacggcgtctggactgtttgtaaactttttgccaacattttggatgaacgctgcttattcctgtgaatcaaggggtgatctcctgcagcctggaagaaacaaaaagggatgggtagtaaaaatctggatcaatatactagttccggacaattatcctgcaaattctgccaggtaatgaaagtgagtagggtctccataacctggaggtttctttgttttggaaaataaaaccaagtaacttcataacccccaggggaaaatttttatatcttggcaagtaaaattttagatggaaataatctactatgccacccttgcaggaattgctattctcactctactatttgtagtagagctatataacagtagcactttctaattgaattttttttttgagacgttgtcttgctctgttgcccaggctggagtgcagtggcacaatcttggctcactgcaacctctgtctcccaggttcaagtgattctcctgcctcagcctcctgagtagctgggatcacaggcacctgccaccacgcctggctaatttttgtatttttagtagagacgaggttttaccatgttggccaggctggtctcaaactcctgacctcaagtgatctgcccaccttggcctcccaaagtgctgggattacaggtgtgagccaccatgcccagccatgttttgctcaattattatacctatagcagggataatagttaccaacaaaaaggaagcatgaaaattttactatcactgagtctgctagaacttcttattgggtttggtaatatgtcacaccctggctatgcaaagaaggttataaaagaaagagattttatgtaagaaaggaccttgtatggtaaatactcgtcctaaaaagaatagttggttgtttttgttttgttttgttttttgagacagagtcttgctatgttgcccaggcttaagtgcactggcacaatctcagctcactgcaacctccacctcccaggttcaggcgattctgctgcctcagcctcccaagtagctgggattacaggcgtgtgccaccatgcccagctaatttttttttttttttttttttagtagaaatagggtttcaccatattggccaggctggtcttgaactcctgatctcaagtaatacacccgcctcagcctcccaaagtgctaggattataggtgtgagccactacacctggcctcgttgtttaaaaaaaaggatgttcaagacaagtcggaaagtttaagcatgtcttagatggtctgtggaagtcatgaagggattcataatttaggaattatgcaggaaagatttagccaaagttaacactaaagttaccctagccacccaaatccagtgccacttatcctaaaaggaatgttacttttattttgttatttttactttttggccaggcacagtggctcacgcctgtaaccccaacactttgggaggccaaggtgggcagatcacttgaggtcaggattttgagaccatcctggccagcatggtgaaaccccatctctactaaaaatttaaaaattacctgggcatggtggcatgtgcccataatcccagctacttgggaggctgaggcaggagaattgcttgaacctgggaggtggaggttgcagtgagctgagattgcaccactacacaccagcccaggcaacagagcaaaactccatctcaaaaaaaaaaaaaaaaaagaaaaagaaaaaggaatgttgcttttatattaacatttcagcaacatctggtggaggcaagccagtgttagaacccatcagagtggctgacagcagtcaaactccaaacgctgcttcagacagaaccacgcatggacacgcctttcttccgaggacccttagattggccccaggaggagccctagctgctgttccccacgcagtgccccttttcagcaagaagcagccggaaagagtctttatccaacacccgctaacaatagttagggttacaccactccagagcgggggaatgatacaggagttaagaagaaattacttaggcagatagtgagggtatggaagtcttcagtaaggttttccttttagtgaaaaacagccccaaatcattttcctttctaacaaagaacagcctgtaaaattgagctgcagacatacatgccagcagttgtgccaatcatgttcgagatggcggctccctcttcccttctctgccagccacgtgtacagtaaggagcagacaagatggcactggccaaggggacagttcgcttgcataatgagattagggtggggcggccagccttccccgcacattgtgtaaatatcatacctaattgaaccaatctgtgagccccatgtaaatcagacaccccctcctcaagccagactataaaatccagcacatctgctgctggccagacttttcctctcgttaagtcccctctctctcactagagagagagctgttttattttctctttcttttgcctattaaacctctgctcattcacttaaggtgcttagcacagtgtctgtaaatagaaatccctcaaaacatattcgttattatttttaactttattttaagataatgttatttatttatttatttattttattttattttatttttttttgagtttcactcttgtcacccaggctggagtgcaatggcgtgatctcggctcactgcaacctccacctcctgggttcaagcgattctcctgcctcagcctcacgagtagctgggactacaggtgcccaccaccacccagctaatttttgtatttttagtagagatggggtttcaccatgttggccaggctggtgtcgaactcctgacctcaggggatcctcccgcctctgcctcccaaaatgcagagattacaggcgtgagctaacatgcccggtcaagagaagagttaactcttaaaaagactgttatcatgtcagataagaacagcaactttgtagctttctgaaccctctcaacttgccatgcagaataccacagccttaccagatggacatggcagatgaaggagttcaaaacagtggagcagctagaaacttaaaggatcaattctagaaatgagaaagtcacagttgggttggattcaaaatctgagtataaactctgcctaaattcctggctggctggccatactacaaaatgtacacaggagctccagggacccctacaaaatggcaaggaggaactgagtgggggccaggggtgggggcacccgggatcctacctcaaagacagaagtgatcctggtgagatttatgagttttatactgagtctgttcctcaacccacacacaattcaggtggcaaaaagtgaaagcattattggcttgaagggtcctgagacagaacttggggctcataagacaacatgaaatgtagagggtgtgccccatgcacaatctgttacccctcagctcgaaatctattattctttgccctgtaaggcataagaagaggtaggttcgcttcctggttcctgtgtactttcttcccctgtgatatgactcccagaagcactcaggaggatcagtggtgcttattctctctctctcttttttttttgacatggagtctcgctctgtcgcccaggctggagtgcggtggcgtgatctcagcttactggaacctccacctcccaggttcaagtgattctcctgcctcagcctcctgagtagctgggattacagtcacgtgccaccacgcctgcctaatttttttgtatttttagtggaaacaaggtttcaccgtgttagccaggatggtatcgaactcctgacctcgtgatccatctgcctcagcctcccaaagtgctgggattacaggcgtgagccactgcacctagcctttttttttttttcgacagagttttgctctgtcacccaggctggattgcagtggcacaatcttggctgactgcagcctccgccttccaggttcaagcaattctcctgcctcagtctcccaagtagctgagattacaggcgtctgccaccacacctagctaattttggtatttttagtagagacgggtttttgccatgttggccaggctggtctcgaactcctgacctcaggtgatccacccgcctcagcctcccaaagtgttgggattacaggcgtgagccagtgttgggattacaggcatgagccaccacacccagccctagacagggtaattatgtaagaaaaagaaataaaaaatatccatattgaagagaaagaaataaaactttgtcaattaacagacggcatgaccttgtatgaagaaaatcatggctgggcacagtggctcatgcttgtaaatcccagcactttgggaggctgaggtgggagaatcatttgaacccaggagttcaagaccagcctgggcaacatagggagaccccatctctactgaatgaatgaaagaatgaatgaaggagcaagccaggtgtagtggtgcacgtctgtagtccccgctactcagaaggctgaggtgggaggatctcttaagacccggaagttgaggctgcagtaagccacaatccacagtcccacgctgcactccagcctgggtgacagagcaggactctacctaaaaatatatatatatataagtaaagaaaatcctaaggaatccacgcacatacaaaaatattacaactaataaatgatttcagcgaggtttgaggacacaagatcaataaacaaaaagctacaataatcaagagtgtggtactaacataaaaatagacatataggccaggtgcgatggctcacgcttgtaatcccagcactttgggaggccgaggtgggcagatcacctgaggtcaggagtttgagaccagtctggccaacatggcgaaaatccgtctctactaaaaatataaaaattagccgggagtggtggcgggtgcctgtgatcccagctacgcaggaggctgaggcaggagaatcgcttgaacctgggaggcggaggttgcagtgagtggagattgtgccattgcgctccagcctgggcaacagagcaagactctgtctcaaaaaaaaaaaaaaaaaaagaaagaaagaaacaaaagtgttttcaacaaatggtgctgggacaaccgaatattcatatgcaaaagaatgaacttggacccttccttataccatctacaaacattccaaatgcatcacaggtgtacttgtaagagacaaaattagaaaacacttagaataaatcataggagtaaaccttcatgacctccagtgaggcaatcattacttagacatgagaccgaaagcacaagggacaaaagaaaaaaatagataaattggactggacaaaatgtaaaagtcttatgctgcagataatatcattaagaaagtgaggtgtggggcgcggtggctcacgcctgtaatcccagcactttgggaggccgaggcgggcggatcacttgaggtcaggagtttgagacagcctggccaacatggtgaaacaccatctctactaaaatacaaaaattagccaggcatggtggcacacacctataatcccagctacttgggaggctgaagcacgagaattgcttgaacccgggaggtggaggttgcagtgagccgagatcatgccactcactccagcctgggtggtagagtgagactccatctcaaaataaataaatacataaataaaaataaaaaaacacagaaagggaaaaaatatttgcaactcatacatatgataaagtgtttgtatccagcatcgagaccatcctggctaacacggtgaaaccccgtctctactaaaaatgcaaaaaattagccgggcgaggtggcaggcgcctgtagtcccagctactcgggaggctaaggcaggagaatggcaggaaccccggggggtgtagcctgcagtgagccgagatcgcgccactgcactccagcctgggcgacagcgagactccgtctcaaaaaaaaaaaaaagtatttgtatccagaatatataccaatatgagttgatgtattgatatataccaatattgaccaatatgtatctagaatatatatcagttagttttttaaaagttggcttcagaattgtttataacaatgttgaatactaaatgattatgttaatgcctttataatatttaatattttatataaataaaataaaatgtagtgtcattctagaattctgtacccaggaaaatcattgttcacatacaaaggcaggcaggccacaaacattttccaaatatgtaagcatggagagaaggttgttctcatgatactttctctaaaagttttcaaagagtagcattttccaatagaactttctgcaatgatggaaatatctgtatcttcaccctccattatggtgaaatcttcaaccccacgtagttagctattaagcatctaaaatgtcactagtgcaactggagaactgaattttattaattttatcaacttgttaattgattaataagttaaattaattttattaagtttatttttattttactttatttgagacagggtctcgttctgtcacccacgctggagtgccatggcctcaacttcccaggctcaagcaagccttccacttcagcctccctagtagctgggacttacaggtgtgtgcctggctaatttttgtattttttgtagagacaaagtttcatcatgttgcccacagtggtctcgaactcctgggctcaagccatccgcccacccccaccttccaaagtgttgcgattacaggcgtcagccatcgccttatttattttattttatttttttttttttgagagggagtctcgctctgtcgcccaggctggagtgcagtggcatgatcttggctcattgcaagctccgcctcccgggttcacgccattctcctgcctcagcctcccgagtagctgggactacaggtgcccgccaacacgcccggctaattttttgtgtttttttcagtagagatggggtttcaccttgttagccagatggtcttgatctcctgacctcgtgatccgcccgcctgggccttccaaagtgctgggattacaggcgtgagccagcgcgtccagccaatcgccttatttttaagtttaaatagctatgcatggatatcttttttatagtgtagagtatttcacactgaagagaaggtaaaatagttccttccttccttccttccttccttcctttctttcttctttatctctttctttctttctctttctttctttctttttaaatttgagacagggttttgttctgtcacccaggccggagtgtagtggcacagtcctagctcacttcgtctccaactcctagtctcaggcgatcctcctgcatcagcttcccagatagctaggactacaggtacacccaaccacatccagctaattttttttttttcccagacggagtcttgctctctcacccaggctggagtgtaatggcgtgatcacggctcactgcaacctccgccttccaggttcaagtgattctcccgcctcagcctcctgagtcgctgagattacaggcgcctgccaccacgcccagctaattttttgtattttcagtagagactgggtttcaccatgttggccaggctggtctcgaactcctgaattcatgattcgcccgccttagcctcccaaagttctgggattacaggcgtgagccattgcgcctggtctaatttttaaaatatgttttagatttgggggattgggagggtctctctatgtttcctgggctggtctccaactcctggcctcaagcaatccccctgcttaggcctcataaaatgcttggattgaaggcatgagccactgtgcccagcccaaaacagcactttttttttttttgagacggagtctcgctctgtcgcccaggtgggagtgcagtggtgcaatctcggctcactgcaatctctgactcctggattcaagtgattctcccacctcagtctcctgagtagctgggaaaataggcgtacgccaccacgcccagctaatttttgtatttttggtagagatgtgatttcaaccatgttggccaggttggtcttgaactcctgacctcaagtgatctggccaccttggcctcccaaagtgctaggattacaggcatgagccaccacaccagcttacccagcattctctacagtcacaccccctatgggggagatgaaagggaaaaaagacaaaaaaaaaattataggagtccgggtgcagtggctcacacctgtaatcccagcactctgagaggccgaggcaggtagatcacttgaggtcaggggttggagatcagcctggccaacctggtgaaaccctgtatctactaaaaatacaaaaattagctgggcatggcggtatgtgcctgtaattccagctagtcgggaggctgaggcaggagaatcgcttgaacccaggaggcggaggttgcagtgagctgaggtcacaccactgcactccagcctgggccacagagactcaaaaaaaaattatagggaaaaaaagaaaaaattctaccagcattaaaataattataaaatgtatatttttgagacagggtcttactctgttgcccaggttacaatgctatgatgtgatgatcatggctcactgcagcctaaacctccccaggctcaggtgattctcacctcagcctcctgggtagcttagcctcccgggcagcctcccaggtagctgggactacaggcatgcatcaccatgcctggctaatttttgtatgtttgtagagacagggttttgccatgttgctcaggccagtcttgaactcctgagctcaagtgattcacccacctcaacctcccaaagtgctggaattacaggcatgatccaccatgcctggcctccatacatccatattaaccttgaacgtaaatagtccgaatgccccacttaaaaggcacagggtgtcaagttggattaaaaaaaacactacctatccatctactgtcttcaagagacccatctcacatgtagtgacacccatatgctcagagtaaagcattggagagagatctagccacaaacagaacacaagaaagagcagggtcactattcttaatcagataaagcagactttaaaccaacaacaataaaaatggacaaagaaaggcattatgcagtgataaagaattcaattcaataagaagacaaatatcctaaatatatttatacccaatattggatcacccagatttatgagtccttctagacctatgaaaagactttgaaagccacacaataatagtagggtacttcaacacctgactgacactgctagaccgatcattgaggcagaaaactgacaaaaataggctgggcacagtggctcatgcctgtaatcccagcactttgggaggctgaggtgggcagatcacttgaggccaggagttcgagaccagtctggccaacatggtgaaaccctatctctgttttgtaaaatacaaaaattaggtgggcatggtggtgcacgcctgtgttcccagctactcaggaggctgaggcaggagaatcgcttgagctgggaggtagaggttgcagtgagctaagattgcgctactgcactccagcctggatgaaagagcgagactctgtctcagacaaaagaaaaagaaaaaggaaggaaggaaagaaaagaaagaggaaggaaggaaggaagggagaaagaagaaagaaagctgacaaaaattctggacttaaattcaacacttgaccaattggacctaatagacatctacagaatactccacccatcaaccacaggaatatacatttttctcatctgcacatagaacacattccaccacatgcctggccataaagcaagtttcgataaatttaaaaaaacctaaatcatagcaaccatattctcagacctcggtagaataaaaatggaaatcaataccaagaagatctctttaaaccacacagttacatggaaattaaacaacttgctcctaaaagacttttgggtaaatagtgcaattaaggcagaagtaaaaaaatctttgaaataaatgaaaacagagacataacatacggaaatctctgggatacagcaaaagcagtgttaagagaaaagtttatggtgctaaacacctacctcaaaaagttagaaagatctcaaattaatgaggtaacatcccacctagaggaactgcaattattggggaacctgccctgatagtcacgtaagttcttttctattttccctaaacatccgctggtttgagaaataaagggacagagtacaaagagagaaattttaaagccgggcatctgggggagacatcacatgtcggtaggttccacgatgccccacaagctgcaaaaccagcaagtttttattagggagtttcaaaaggggagggagtgtgcgaataggtgtgggtcacagatcacgtctttcatgaggtaatagaatatcacaaggcaaatggaggcagggcgagatcacatgaccacaggactggggtgaaattaaaattgctaatgaagtttcgggcaccattgtcattgataacatcttatcaggagacagggttttgagatcaaccggtctgaccaaatttattaggggggaatttcctcttcctaataagcctgggagtgctatgggagactggggtttatttcatccctacagtctcgaccacagaagatggccacacccaagggggccatttatagacccaccctcaggggtgcattctctttctcagggatgttccttgctgagaaaaagaattcagcaatatttctcccatttgcttttgaaagaagagaaatatggctcttttccgcccgtctcaccggtggtcagagtttaaggttatcgctgttattccctgaacaattgctgttatcctgttcttttttcaaggtgcccagatttcatattgttcaaacacacatgttctacaatttgtgcagttaacgcaattatcacagggtcctgaggcgacatacatcctccttggtttacgagctgacaggattaacagattaaagtaaagacaggcataggaaatcataagggtattgattggggaagtgataagtgtccatgaaatcttcagagattgcagtaaagacaggcataagaaattataaaagtattaatttgggaaactaataaatgtccatgaaatcttcacaatccacgttcttctgccatggcttcagcgggtccctccgtttggggtccctgacttcccgcaacacaatggccccaaagctagcaggagaaaagaaataattaaaatcagagcagaactgaatgaaattgggacacaaacatccatacaaaaaatcaatgaaaccaaaagttggttttctgagaggataaacaagatcgataggccactagctagattaacaaagaaaaaaagaggctgggtgtggtggctcatgcctgtaaccccagcactttgggaggccgaggcaagtggatcacttgaggtcaggggttcgagaccagcctggccaacatggtgaaaccccgtctctactaaaaatacaaaaattagctgggtgtggtggcgcacgcctgtaatcccagccacttgggaggctgaggcaggagaatcacttgaacctgggaggtggaggttgtggtgagccaagattgcaccactgctcttcagcgtgggcagcagagtgagactgtatctaaaataaataaataaataaataataaaaataataataataaaaaaatttaaaaaacgaagaaaaaaaagacagaatatccaaataagcacaatcagaaatgacattacaacaagtccacagtgatttaaaaaagatcctcaagatgaacacctctatggacacaaacttgaaaatctgaaggaaatggataaattcctggaaacacacaatctgccaattttgaagcaggaagaaattgaaaccctgaacagaccaatatcaagttatgattctgaatcattaaaaggagtctaccaaccaagaaaagcccctgatcagatggattcacagctgaattctactacatgtacaaagactaagactaatcctcctgtattagtccgttctcacactgctataaaggcatacccaagactgggtaatttataaagaaaagaggtttaattgactcacagttctgcaaggctggggaagccttaggaaacttatagcagaaggagaagcagacacatcttacatggtggcaggagagagagaatgaatgcaagcataggagaaactgccacttttaaaaccagaaatcagatcaggctgggcacagtggttcatgcctatcatcccagcactttgggaggctgaggtgggtggatcacctgaggtcagaagttcaagaccagcctggccaacatggtgaaaccctgtctctacaaaagtacaaaaattagccagacgtggtgatgcatgcctgtgatcccagctacttgagaggctgaagcgggagaattgcttgaacctgggaggcacaggttgcagtgagctgagatcatgccattgcactccaccctgggcaacagaacaagactccatctcaaaaagaaataaaaataaataaataaataaataaaaccatcagatctcatgagactcattattgggagaacagcatggggggaactgcccccataatccaatcacttccctcccttgacacatggggattaaaattcaaaatgagatttgggtggggacacagagccaaaccacatcacctactaaaactattcccaaaaaattgaggagagacccctccctaactcattctaggaagccagtatcaccctgatcccaaaacctggcaaaaacaatgaaaaaataaaactgctgggtatggtggctcacgcttgtaatccctgcactttgggagaactgagggaggtggatccttgaggtcaggagttcgagaccagcctggccaacatggtgaaacctcatctctactaaaaatacaaaaattagccgggtgtggtggtgcatgcctatagttccagctacttgggaggctgaggcaggagaatcgctcgcacttgggaggtggaggttgcagtgagcccagatcgcagcactgcactccagcctgggagacagagtgagactgtctaaaaaaaaaaaaaaaaaaaaaaaaaaaaaaaaagaaagaaagaaaagaaaactacaggccaatatccctgatgaaaatggatgcaataatcttcaacaaaatactagcaaactgaatccagcagcacatcaaaaagttaattcatgaggccgagataggtggatcacttgaggccagaaattcaagaccaccctggccaatatggtgaaacccatctttactaaaaatacaaaaattagctgggtgtgttggtatgtgcctgtaatcctaactattcaggaggctgaggcatgagaattgcttgaacatgggaggcggaggttgcagtgagccgagatcatgccattgcactccagactgggtgacagagtgagactctatctcaaaaaaaaaaaaaaaaaaaaaaacagatgcagtggctcatgcctgtagtcccagcactttcggaggctgaggtgggcagattacctgaggtcctaagtttgagaccagcctggccaatataatgaaaccctgtctctactaaaaatacagaaattagccaggcattgtggcccacacctgtagtcccagctactcaggaggctgaggcaggagaatcacttgaacccaagaggtggagggtgcagtgagccaagatcgcaccactgcactccagcctgggtgacagagtgagagcccatgtcaaaaaaaaaaaaaaaaaggccgggcgcggtggctcaagcctgtaatcccagcactttgggaggccgaggcaggcgatcacaaggtcaggagatcaagaccatcctggctaatgtggtgaaaccccatctctactaaaaatacaaaaaaaaaaaaaattagccgggtgtggtggagggcgcctgtagtcccagctactcgggagactgaggcaggagaatggcatgaacttgggaggtggagcttgcagtgagccgagattgcaccactgcactccagcctgggctacagagcgagactccatctgaaaaaaaaaagaaagaaagaaaaaagaaatcttagatgacaccagcaaatggaaaaacattcgatgctcatgtattggaaaaatcattatcgttaaaatggtatactgccaaaagcaatctacagattcaacattatttatttatctatttattttttggagacagagtcctctgtcacccaggctggagtgcaatggtgcaatttaggctcactgcaacctccgcctctcaggttcaagccattctcctgcctcagcctcctgagtagctgggattacagatgcctgccaccacacctgattcatttttgtattttagtagagacagggctttaccattttgcccaggctgatctcgaactcctgagctcaggtgatccgccccccttggcctcccagagtgctagtattagaggtgtgagccaccacacccagcctaaacattattcctatcaaggtactgtgtccagagttggttccttctggtgggtttgtggtctcggtgacttcaagaatgaagccgtggaccttcaccgtgtgacagctcttaaaggtggcacagacccaaagagtgagcagcagcaagatttattttgaacagtgaaagaacaaagcttccacatcgtggcaggggacccgagcgggttgccactgctggctgtggatggccagcttttattcccttattggccctcccatgttccatttctgtcctatcaaagtgcctttcttttttttttgagacggagtctcactctgtcccccaggctggagggcagtggcacgatcttggctcactgcaagctccgcctcccggattcacgccattctcctgcctcagcctcccgagtagctgggactacaggcacctgccaccacgcccggctaattttttgtatttttagtagagatggggtttcaccatgttagccaggatagtctcaatctcctgaccttgtgatccgcctgcctcagcctcccaaagtgctgggattacaggcgtgagccaccacgcctggcctcatgtacaggcttttgtgcagacctgagtttttagttcatttggataaatatcaaggagctcgactgctggattgtgtggtaagagcatgtttagttttctaaggaactgccaactctcttccaaactggctgtataccattttgcattcccaccaacaatgaatggcccttcctattgcttttcattctcaccagcatttggtgtgtaatttctgaataaaatcctttgtgttttccaagtatacagttattttgatctgaaaataataatttttcctccattctgatttctctgtctctatattctacctcttgtcaaattatattggctaacacatccagaaaaatattaagtaatagctgtaaaaatggataaactgcttttgttcttgacttcaagtttgggagcacttttatggtgcccccattaagtatgatgctgaataattttttgtatttttagtagagatggggtttcaccatgttagccaggatggtcttgatctcctgaccttctgatccgcccacttcggcctcccaaagtgctaagattatacagtgagccaccgcccagcccagagtgcacttttttcaatcctccctgcaattggctacttttaggatcctgctgattggtgcattttacagaacactgattggtgcattttacagcatgctgattggtgtgttttacagagtgctgattggtgcattttacaatcctcttgctagctacagcgtgctgattggtgcgttttacagagcgctgattggtgcattttacaatctgcttgctagctacagagcgctgattggtgcgttttacagagcactgattggtgcattttacaattctcttgctagctacaaagcattgattggcgcatttttacagagtgccgattggtgcattttacaatcctctttaaagacagaaaagttctccaagtccccactcaacccaggaagtccagctggcttcacctgtcactaccaacgtcatttttcaaggaactagaaaaaattattctaaaatctacatggaatcagaaagactctgaatagcgaaagcaatcctaagtggaaagaataaagccagaggcatcacattactggacttcaagctatactacaaggctacagtaaccaaaacagcatggtattggttaaaaaaaaaacaacacctatggtcatctgatctttggcaaggttgataataacaagcaaaggggaaagaacactgtattcaataaattgtgctaagatagttggctagctatatgcaaaagaataaaactggagccccacttttcaccgtatattaaaattaactcaaaacaaattgagaatttaaatgtaacccttcaagctataagaatcgtagaagaaatcctgggaaacaccattctggacattggctttgggaaataatttatgactaaatcctcaaaagcaattgcaacaaaaccaaaacttgacaaatgggacctaattaaagcaaagaacttctgcacagcaaaagaacctatcaacagagtaaacagacaacttacaatgggagaaaatattcataatttatgcatccaacaaaggttcaatatcagaatctataaggaacttaactgaacaaacaagaaacaaatatccccattaaaaatgggcaaatggctgggagaggcggctcacacctgtaatcccagaacttttggagcccaaggagggcagattacgaggttgggagttcaagaccagcctgtccaacatggtgaaaccccaactctattaaaaatacaaaaagtagccaggcgtggtggtgtgcgcctgtaatcccagctacttgggaggcttaggcaggagaattgcttgaacccaggacatagagggtgcagtgagccaagattgtgccattgcactccagcctgggcaatacagtaagactccatgtaaataaataaatatataaataaataaataaaataaaatgggcaaaacacataaataggaacttctcaaaagaagacatacaagtggcccacaaacatataaaaaaatgctcaacatcactaatcatcagagaaaagcaaatgaaaatcacaattagataccatctcacaccagtcggaatagctattattaaaaagccaaaaaataacatgctgttgaggctgcagagaaatgggaacacttatactctgttggtgaaaatgtaaattagttcagttactgtggaaagcagtttggagatttcttttcttttttttttcttcaagacagagtcttgctctgtcacgcatgctggagtgcagtggtacgatctcggctcactgcaacttctgcctcccagggtcaggcaattctcctgcctcagcctccagagtagctgggattacggtcacccaccaccacacccagctaatttttgtgtttttagtagagacagggtttcaccatgttggccaggctggtctcaaactcctgacctaaggtgatctgctccactcggcctcccaaagtgctgggattacaggcgtgatccactgtgcccggcctggagatttcttaaataacttaaaacagaactaccatttgatccagcaatcccattactgggtatacatccaaaagaaaataaattatcctaccaaaaaaacacatgcatttgtatgttcattgcagcactgttcacaatagcaatgacatggagtcaacctcggtgcccatcgatggtggactggataaagaaaatgtacaaacacgctatggaatacttcacagccataaaaagtatgaagtcatgtcttttgctgaaatatgaatgtagcttgaggctgttatcctaagtgaaataatgcaggaacaaaaatccaaatgctacatgctctcagttataagtagaagctaaataatgagtattcgtggatataaggatggtaacaacaggccagatgcagtggctcacgcctgtaatcccagcactttggaaggctgagatgggtggatcacgaggtcaggggtttgagaccagcctggccaacatggtgaaactctatctcttctaaaaatacaaaaattagctgggtgtggtggcggtcacctgtaataccagctacttgggaggctgaggcagaatcacttgaacctgggaggcagaggttgcagtgagccgagattgcgccattgtactccagcctgggcaacaagggcgaagcttggcctcaaaaaaaaaaaacaaacaacaacaacaaaaaaaaacaaaacctgaaaatctaatatttaaaattaagaactcaatgtatagatttaacagcagattggagattatagaagatagactcaataacctgaaaaacagaaaaccttcaaactgaataattgaaaaaaaaattgacatcacaaagtgtaaaagacacggtgaacaagatcaaataatcttacatatgggctgggtgccgtggctcatgcctgtaatcccagcactttgggaggctgaggcaggtggatcaccggaggtcaggagttgaagaccggcctgaccaacatggtgaaaccctatctctactaaaaatacaaaaattagccgggcgtggtggtgggcgcttgtaattctggctactcgataataatactattataatagtattatctacctcagtagataatactgctgaggcaggattatcgcttgaacccgggaggcagaggcagaggttgcagtgagacgagattgcgccactgcactccagcttgagcaaaaagagtgaaactctgtctcaataataataataataatcttacatatgtaattggtgtctcggagaacaggcatagagaatgcagcaaaaaccatatctgaagagataatgattgagaatttctcaaaactgatgcaagacatctacccacaaatcagagaaactcaatgatatccaagacagataaatacaaagaaaacaaagatagggcacaaaataaatggctaaaaatcactaacaggctgggtgcggtggctcacgcctgtaatcccagcactttggggggctgaggcgggcagatcacgaggtcaggagatcgagattatcctggctaacttggtgaaacccggtctctactaaagaaatacaaaaaaaattagccaagcgtggtggtggacgcctgtagtcccagctactcaggaggctgaggcaggagaatggcgtgaacccgggaggcagagcttgcagtgagccgagatggcgccactgcactgcagcctgggcgacagagcgacactcctctaaaaaaaaaaaaaaaatcactgacaaagagaaactgttaaaaagaagtgagagggcctggtgtggtggttcacgcctgtaattcgagcactgtgggaggcccaggtgggaggatcacttgagctcaggggttcaagaccagcctgggcaacatagggagatgtcatcgctacaaaaataatgatagtaatagtaataaaaaattagccgggcgtggtgcaggagcctgtggtcgcaggtaccctggaagatgaggtgggaggatcgcttgagcccaggaggcagaggttacagcgagcctagggtgtgccacggcactccggcttgggcgagacagcaagaccctgtttggaaaaaaaaaaaaaagaaaagaaaaaagaaaaaaaaatcaacagtaattgcagccattgcttagaactaagactaaacaaagcttttgtttggaaaggagtactttttcattaacattgtttagaattttctgacacatgatgataattaaaagcaaaccatcctgcagttggcttcggtattgtttttatcttctccaccatcaatgcatatccttactgcctacacaggctctcagcaacgcactgttggttttccattgcagtcacctccactttattcttccagatcgagtatgttcaaaactgaactcatcttccgccataaatctgctattattatgtttttgcctgtcaggacatcggcttataattttggaaagcattcacagttggggcgggtaagacatagataaagaggccaatcacaataccaggggtaagatcaataggaaaaccagagagcggacgcctgggccaggcctcacaacgtccagagctggaatgggtcttttgctttcggcgcaggggtgacgggatcagcggagggtaggggtgtacactagctgcggtctgatttagcccttttaggttaaaagctggagaaggggctgaagtctcaaacgcgcttagcagctcctgaacgcggttcccatcccagcgcgttctgagggaggccggggctaaggacgcggtgacgggcgggggcggggcggccccgggtcgggaggcggggcgggagcgccggaagcgggcggtgccaggcccagcctcgcaggcggaagggcgcggaggaggtgacgcgataggccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcaggtaagcggggacgcgggcagacgagtgacggactcagcgatcgcctggcggggctggctggggccattcccgcgccggtgcgccacctcagcgcccggtccggaggcctcgagccgccctcccccgcccgagctggaggccgccgtccgtctcggccacagcctccctttccgggggaggcgagcgagctcgtcccgaggggccgctgccctgcgctctcgctccagccgggctgtgcgtcgcaggcaccgggaagctggcgccccccagctcctcctgaagccgggaaagctctgagaggaggagccgctgtcacaggcctccagctccggccgccgtggaagtccggggtttttatttgcttagaccgctctgcctccttccggccttcgtttctttcctcgcgctccccgggacccttttccagagagcccggttgggcatgagcgcggtgggagacgtcttttcccttcggtctgctctgagcggtatcagcctccgctctacgccctgtggccactctgtcggggtggagggatgcggagaggatgtgggagttttggacttagagcgagaatagccgaggtgaaatcctaccctgctctctggtagtgtttttcatctcatgctagatagacatttcgacctttttcaccgcaggtaaagtgggactttcttctaccaatgtaaattataatgtttggagaattaaatgaagaaagcagacgttagttatgaaatgttttgagaatctggttaaatttaatttaagaatatccaggacacttcatgataggttcctacttatgttttttttttgcattttgcccggaataactaagcttggtatggaaaaggttgcctagagatgccaggcgctcgtgtggtcagagcctaactgcagtctctgttttgggtgggcagcatcaggaagaaaccagactctctcctagccatccacatgtctcacgcttattgatggcatattattggtatatgagggatggcttatatcagttttgatctttactcaagatagctttttcccagtgcatcttttctaggagaaaagcttggtatgtagaggagggtgctggggaggggggcttcatttacacctgggctcacaatttttttttggaggggggacagggtctcactctgacacccagcctggagtgcagtggcgcgatcttttcagctcactgcaacctcctcctcccaggttcaagcgattctcctgcctcagcctccagagtagctgggattacaggtgcccgccatcgcgcccggctaatttttgtatttttagtagacatggggtttcaccatgttggccaggctggtctcgacctcctgacctcaagtgatctacctgcttccgcctctcaaaagtgctgggatcagccgggcgcggtggttgacgcctgtaatcccagcactttgggaggccgaggcgggcagatcacctgaggtcgggagttcgagatcagcctaaccaacatggtgaaaccccatctctactaaaaatacaaaattagccaggcgtggtggcgcatgcctgtaatcccagctactcggaaggctgaggcaggagactagcttgaacccgggaggcgaggttgtggtgagctgagatagtgccattacactccagcctgggcaacaagagcaaaactccgtctcaaaaaaaaaaaaaaaaaaaaaaaaaggtgctgggattacaggagtgagtcactgcgcctgggctatattactttctaaatcagcctttttttttttttttggtaggccattatgtgaatccttcaaaaatcatagaaaaattgaaatttaacaatattttgcttttattctagcttgtcataaacccagtgctctatacacaggcctgcctttctgcctccttcatcctggcatgcatggccatttactttgtgttattagccagcttcctatggagctcagtttgagaacggggttctgtgcttctctagttgccaaacatctgattgaagtagatcaccttggcatttgcgatattaagcatgtctttgcgaatttttagttcctttttcttttcttggttagattgtactctgtcactgatttaaagaatttggtagacgctcagaaagggtcaactggtaaggtggtcacagtgctttacatgtatttttcttacctattatggtgaaacccttgtgactttttttgggcgtgggtaatattttcaaaattaaggtaaataggccatcaggctgcgttgaactttctcttttagggaaatatattcattctccaattattctttggtagccttcttattgctttagcaattcctactctattattagtagagccggaaatggaccctacatcacagattctccaaatatactaaattattttttctctaaaatgatcatgtttatagcatgttgattttctttttttttcttttgagacagagtttcactcttgtgcaggctggagggcaacagcttgatctctgctcactgcaacttccgcctcccgggttcaagtgattgtcctgtctcagcctcccaagtagctgggattacaagcgcccaccaccacgcccggctaatttttgtatttttagtagagatggggtttcaccatgttggccaggctggtcttgaactcctgacctcaagtgatctctccgtctcagcctcccaaagcgcggggattacaggtgtgagccactgtatccggtcagcagcatgttgattttctacaaccagatgacaaaggatatcctaaagtcagtgatttaaaaagtcatgttggcttggtgcggtggctcatgcctgtaatcccagcactttgggaggccgaggcgggtggatcacgagtcaggagttagagaacagcctggccaacatggtgaaactccgtctgtactgaaaatacaaaaaaattagctgggcatggtggcgggcgcctataatcccagctactcgggaggctgaggcaggagaatcgtttgaacccatgaggtagaggttgcagtgagccgaggttgcaccattgcattccagctttggcaacagggtgagactctgtctcagaaaaaaaaacaaaaaacaagtgatggtaacacataggttgtctaatacattcagagtctagagagacctggtatgtatctgagaaaccaaatagctgaatctctaaaattttatttttgtgtctggaataccttaattctgaagttttagttgttgttgaatttcacattctgacaggagacaagtagaggtacatgtgaagggttagtatgaacccagggttacagtttcaatctaaactgatactgcagagttaacattgaaacaaagcagctctagggagctggcaaaaattgaaggttagaagtcacttgctggctcttgaggcagtcttctgactctgaaactacttgagactaaaattttcaagaattttttaacttaattttgtaaagatataatttacggcctggtgcagtggctcatgcctgtaatcccagcacttagggaggccgaggtgggttgatcacctgaggtcaggagtttgagaccagccaacataatgagaccccatctctactaaaaatacaaaaattagctgggcatggtggcacacactcgtactcctagctactcaggaggctgaggcaggagaatctcttgaacctgggaggtggaggttgcagtgagtcgagatcaggtcactgcactccagcctgggtgacacagtgagactccatctccaaaaaaaaaaaaaaaaatacagtcaaatacatagaccttaagggtttttattttttaaagcatatgtacacaaaatggaagacagaaaaatagcaaaacattttggaagctggaatgcagattgatttaagcagtctgcccgccttggcctcccaaagtgctgggattacaggcgtgagccaccacacttggccgatataactttttcgtagtgaagcttcagttaacctgtacggtggctgcgctgtgaactttcacccaaatattgggctccttaaggggctgtttaggcttggggctgtcctagggtcggtgagtatctagtaagagtgtaaaccttctatttcccttgtgtgcgtgttttatctttgaaggaatgttgatatttggtcagtatgaacatacagcagcatggctgggaatacaggggcagaaatgtaaaggaaacgcatgtgaagtttgcttttaattactggaccgttgtattcaagaaccttcaatggcagtatcttgtctttgctccagggtcagattccctaaagaagaagggatctcctacttggagagtacaaattgggcttccagcagtctggcttctatacttagggaaaggctggaggtcttagtattcgttatgtaaacactcattcttgttcatttaactcaactattttcagtaagatgacctcattctcaactggaccagttgaaaagctttccagtccaggaattctttgtttttacataggattgttttaagctgctacgtgtggttagtggctaccatattggatagcggagctgcactatccagtgtggtagccactagccacatgtagcagcctaaatctaaataattaaaattaaaggtttagttcctcacttgcactagacatgtttcaagtgctcaatggccacatttgcccagaggctaccgtattgggcagagcagatatagaatatttctgtcattgcagaaattttattgggctgtgctgttctagtctagagaagaagactccaggtgtctgcaaggatgggtaggggacagttggctggttttgtggcatgtgggaggatatttaaatcatttgaccaatccttttatttttagcgtcatattcatattcacatccctctgtagaacaattcctgacctgttttgaggtattgttctttagattgctttcctccctgcaagcttgagatttaactttttttttttttttttttttggagacggagtctcgctctgttgcccaggctggagtgcagtggcgtgaacttggctcactgcaacctccacctcccaggttcaagcaattgtcctgcctcagcctcccaagtagctgagattacaggcacatgccaccatgcccggctaatgtttgtattttagtagagacggggtttctccatgttggtcaggctggtcttgaactcctgacctcaggtgattcgcctgcctcggcctcccaaagtgctgggattacaggcgtgagccaccgcgcccggccccagccgagacttaacgtctttagatctttaagtcaatccacattccaactttcaaaatgtttttgctgttgttcggtgttccattttgtgtacatatgctttaaaaaaacaaaagcccttcaggtttatgtatttcactgtaggtaaattatatctttaaaaaattaagttaaaaaattcttggcagccgggcgtggtggctcacgcctgtaatcccagcactttgggagtctgaggcgggtggattgcgaggtcaggagatcaagaccatcctggctaacacggtgaaaccccatctctactaaaaatacaaaaaattagccgggtgtggtggcgggcgcctgaagtcccagctactcgggaggctgaggcaggagaatccttgaacctgggaggcggagcttgcagtgagctgagatgtgccactgcactatagcctgggtgacatagtgagactccatctcaaaaaacaaaacaaaacaaaaaacataatttaattttaattagttatttaggaatgggtcttgctgtgttgcccaggttggtctcaaattcttgacctcaaaggatccttctgcctcagcctcttgagtagctgggattatagacatgcaccatggtgcctggctggttttttcttttaaaaaattaatttattggctcacacctgtaatcttaggtactcagaaggctaagtcaggaggattacttgattgagcctgggagtttggggcttcagtgagccatggctgacagaatgagaccttttttttttaaaaaaaaaaaaagataaaggacaatttttttattcttaatgaagttttaagagggaatgatggtaaaatgtgtctgcttaatctgcagtctttatccagaagtaaagtgcttcatcagaatttaaacatgtataagaatctccactaaaaaaatgtttgagctttacccaggcttcttgaacaatttttatatatcgccttttttgttccaccttggtttttgtcctttccattgtactaaaatttctcctgcaaatgtcaagagaattcagtgaacacttttaatccttatcttgctcgacttctcaacaacctttaactgaccatttccctctttttagaaacctgttctagctttgctgataccacctttacctgatttttgaccttatctccctggtcattttttttcactttcctttgcttagtctttctttatttcttaaatcctggagttccagctgggcacacctgtaatcccagcactttgggaggctgagttgggtggatcacctgaggtcagaggtcgagaccagcctgaccaacatggagaaacccggtctctactaaaaatacaaaattggctgggcgtggtggcgcatgcctgtaatcccagccacttgggagcctgaggcaggagaattgcttgaacccgggaggcggaggttgcagtgagctgagatcgtgccattgtactccagcctgggcaacaagagtgggaaaaaaaaaaaaattcctagagttccttgggctattgccctagggtacattctctcattctcttctaccttttacaaattctttctaggtgatcttatcattttctatagctttggttactctaagctgaaaactggaattcacatgatgtcctcttttcagaattcttgaactgtatatctagctgtatatatccacttggacttctaatggtcatctcaaattgaacatgtgaaagactaaaggcatagtcagtataaccttcccctaatcgatctccgtctgtgtttcgtatcagtgataccactatctacctagtagctgatactggaacatttacccccaacagataggcttttgacaaatgacaagtcctgtcatttctgtgtcctgaagattgattcactttgctacatcctcccagtttttctcttaatccaagaagctgtcccactgtatctgcattgatttacctgtaacagattcctaatgggtttcttctgctgtggccttctccttgccattctgcacattgcaggtagaatgatttttttcaagaatatgaatcagatctttgtctttcagtggcttcacaccaaccttatgttaagtgtcagcatcgtgaatttagctcttctgttcctcatctaccccttccgtgcctctaagtgttactgaagttctttccattccttgaaatactgaattccctctctttcctaggaactcttgctcatcatttgtctcagctgaaaaataatttcttcagagaaaaaataatttcttcagagaggtgtttcctgacccttttgccagatatttccattgtaccctgaatttgactttttttaatttttattttatttttttatttttttgagacagggtcttgctctgtcacccaaactagagtacagtggtgtgatcatagctcagtgaaactttgacctcccatgcccaagcgatccttccacctcaccctcctgagtagatgggaacacaggcatgtaccaccacttttggctattttttttggagacaggatctccctgtgttgcccaggcaggtgatcttgaaatcctgggctcaagcgatactccacctctgcctcccaaagtgctgggattacaggcataagccaccatgcctggccaatattggcagtataccatagtaagcgtttatttgaattacatgtttatttcatattaagaagtttgtttatatagaagtgatttttccactgataaagtaaaatatgatattctaaactagaggttcccaaactttctctgtttacaccctccttaatatattttttacatgtccctaagcttaacagtttgatttattaaataattaggttcagacagcttaagaagtatttatgggccaggcgctgtggctcacgcctgtaattccagcaggcggatcatgaggtcaagagatcgagactatccttgctaacacagtgaaaccccttctctactaaaaatacaaaaaaaattagccgggcctggtggcgggcgtctatagtcccagctaggctgaggcaggagaatggcgtgaacccgggaggcggagcttgcagtgagccgagattgcgccactgcactccagcctgggcgacagagcgagattctgtctcaaaaaaaaaaaaaaaaagaaaagaaaaaagtatttatgttctttcaacctaattgacatctaagaaatacacaaattggaagacaaagtcagatagatgtgatggctcgtgtctataatctcagctctttcggtgggcggatcacttgagtccaggagtttaagaccagtctgggcaacatagaccgtatttctacaaaaaaaaaaaaaaaaattgccaggcgtggtggtgtgtgtctgctgtagtcccagctactcaggaggctgagggaggattgctggagcctggaaagttggggcgagctctgattgcaccagtgcactccagcctgggtgacagagtgagacactctcaaaaaaataagaaagagaaagacaaaattacattttgatttcattcttaaataaccacagttatttaccgtatatacttgttgggcactacaaaacccaaaccgtggaatcatattggactctgccacccacattgcttactttttaattaaaacaaatttgcttttggctgggcatggaggctcatgcctataatcccagcactttgggaggttgaggtgggaagatcgtttgaggccaggagttcaagaccagtctgggcaacatagtgagaccccatcttactaccttattttattttttttaatttttaattttaaatatttatttagagatggagtctcactgtgtcacccaggctggagtgcagtggcatgatcttggctcactgcagcctccactccctggttgaagcgattcttctgcctcaggctcctgagaagctggccattactggtgcccaccaccacacacggctaagttttgtatttttagtaagagacagggtttcaccatgttggccaggctggtctggaactcctgacctcaggtgatctgccctgctcgaccttcaaaagtgctgtgcttacaggtgtgcgccaccgtgcccggccactatctcgctattttaaaaaataaataacatttgtttacatctttgttttctccactcattttttgctctaaattgatatttgcacagtatttttttttaaatcacagcaaccaatagatactcagctttgcaaagattatgatatcatcaaaaggaacatagtgtgatctattttgaagctgaactgtcttgaactagtagtttataaggtgtttgacaagtatagaagattactttttccctgtaatttagaatttcctgttgtgctctcgtgagttctctacagaatcccaggttgccttgggcacagtttgggaactgtgatcctaaacttttgatagtttggtgtatatgcttttagacatttttctccaaacattcaagcatatgcatatatttttccttttaacaaaagtgggctggtacatattggtcagcaacttcattttttccattcagcagtgtatcatggtaaaggtggtggattgaatatatacgtttaattttatgccagcctgaaaatttcattaaaacaatggaggacttaaaaaccctctagataacaaagaacaggaacaatgagaataacaacaatatcgtgaaagctggaaagcagaaaagactaatggcaactaattcgccaacttgagaaagctgtatcctaaaccaacagtggagagagccttcaaatagtcatgttatgttaccaaaccctttaaaagtctcaagattagctgtgtcctgtactgtggaggtggaggtgggacagaaaatatgaggagttgtttgaaagtctgtttcagaaaagtttccactcctgacctccctttcttctccccgtagacataaatagggtaactagagacttactatctggagtagaaaacgattattatctggactgagggataccatgcatagttaaggataaggtactgtgccttatagtggaaatctatatgctgaaggtagaaacctctagctttttttcctgacatagttctcagaatcttgcccctttctgctgtttcccattcaccaaaagcagcctctttcaagtctttgaggtattgttttggtataaacaacatgtctttaaattacctttttatttttatattttatgagatggagtcttcctgtcacccaggccagagtacggtggcatgatctccgctcactgcaatctccgtctctcgggttcaagtgactctcctgcctcagcctcccgagtagctgagattataggtgcccgccaccatgtctggctcatttttgtatttttagtagagacaaggtttcaccacgttggccaggctggtctcgaactcctgacctcaaatgatccgcttgcctcggcctcccaaagtgctggtagtacaggcatgagccaccatgcccggcctaaattacctttttataatgtaacttgtgattacttagtttatgctttatctgttgacttgaagatgaagattgttcttttttacatctgttccccacgtctgtgtacttgcatacttcttatcttccctccaagataccactgtatcttcccactatagggatgctataaggggcagtattaccattccaggtgagataattcttcattgttgtgtttattgcatgatacttagtatccttggaccccagcggtaaatgtcaataccaacctgaatgtattacagcaaccaagaatttcccacacatttccaaatgttaggttgaggtggtatggagtatctggttgagaagcactgggttagatcagtgtttagcttattactattatgtaaatggtagtcatagttaagccatgtagtataccaaggtttacaaccactgttttccctttcttgtacatttttctgttgtccctgaaattaattgtctttatcttttgtttagtgttctctgtacctactactaactgcaaactctcttctggttgtctgtttctcctttatttgctttcatacactttagaaattctatcaggatcacattcttggagccttttgactgacttttgaccgctcccttctggattggtggccctccaggcttaaggcacattgtcattctgcatctatttttactgttatctttagtattctttttgcctgactcttgtttttggatctcatttcctgcatcctgtgtattcttgacttactcccatatttgccagagtaccttctcctgtgactctctgagaaggatgcatgggaggtaaatattttgataacttacatctctgtaaaccttttttgttagttgttatgttagtttcagtctgtcattttgtggtactttctgggagattgctcaaaattttaaatgttttaatgttttacttttaacttcgaaataacttcaaatttaccgaaaaaaattgcaaaatattacagtttttctatatgcttcacctagctttgctccgaagttttgtttcagttttttttgtttgtttgaagacatggtctcactctgttgcccaggctggagtgcagtggcgtgatctcggctcactgcaacttctgcctcctgggttcaagtgattctcctgcctcagcctcccgagtagctgggattacaggttcatgccaccgtgcctggctaatttttgtatttttggtagagacagggtttctctatgttggccaggctggtcttgaactcctgaccttagttgatccacccacctcagcctcccaaagtgctgggatcacaggcatgagccactgtgcccaaccttacttcagtttttttaaggagacagagtcttgctatgttgcccaggctgatcttgaactcttgggctcaaacaatccttctgtctccgcctcccacgtaggtgggtctacaggtgtgcaccactgtacctggcctctccaatgttatagaactgcagcacattgtcaaggccaggcaattaacgttgagagaatactgctaactgatctgcacaccttattccaattttgtcagttgtcacatgacttttctttttctgaactgagactcaatccaggattataccttgtttaattgtcgtctccttaatctcagtctttcattctaggacagtctgtctttgtctttcaggactttgactgatgtgattgaagagtattagccagttattcttttttttttttttttttttgagacggagttttgcttttgtaccccaggctggagtgcaatggcgtgatttcggctcactgtcacctgcgcctcctgggttcaagcaattctcctgcctcagtctcccgagtagctggattacaggtatgtgccaccgtgcccggctaatgtttgtatttttagtagagacagggtttcaccgtgttggccagactggtctcgaactcgcgacctcaggtgatctgcccacctcggcctcccaaagtgttgggattacaggcatgagccaccgcgcctggcccttttccttttttattttttttttgagataggacatcactctgttgcccaggctagagtgccatggtgcaatctcagctcactgcaaccacaaactcctgggctcagttgatccacccacctcagccttctgagtagctgggaccacaggcacatgccaccacacttggctaatttttatatttctttgtagagatggggtttcatcatgttgcccagagtggtctcaaactcctgggctcaaacagtccacccatctcagcctcccaaagtgtgagattgtaggctgagccacagttccctgctggttgtttttaatattttgctattataaacaatgctgcaatgaatagccttgtacatgtgtatatttgtattattgtaggcatgtcttcaggtaaattccttaaagtggggttgctggattaaaaggtaaatacttttgtagttattaaatgttaccagattaccctccaaaaagattggatcaatttgtagtcctcctaacaaagtgtggaaaggcccttcttccccaccaagagaatgtgttataatttttgccaattgtcttataaatgaatttggacatctttcttaagcttaaggaacatttaaaaagctttatttgtaaattgtctccttatgtatttttcctattttccattaggctttttttcagttatctcttaatttaagaggtctatatattagggatattaggcctttatgatacatgttgcaaatatttttttctaatttatcagctgtcttttcattttgttcatttattattttttttaacttccaagcttaattgagtttttaatttctgctattatttttaattttcaagacccctttcttgtttttggccattcctttagaaaaagaataacaccctgttcttttttttcaatggatgtaatatttgcttttgcttctttgagatagtattagttttttttttttttttttgagacagtcttggtctgtcacccaggctggagtgcagtggctcaattttggctcactgcagccttcagaactcccaggttcaagcaattctcgtgtctcagcctcccgagtagctgggattacaagcacgtgccaccacacctggctaatttttttgtatttttagtagggttggggttttaccttgttggccaggttggtctcgaactcctgacctcaagtgatccgcctgtcttggcctcccaaagtgctgggattataggtgtgagccaccacactcagccccctctttttttttaattgtggtaaaatatacataacataaaatttactattttgaccatttttaggtgtacagttcattggcattaaagtacattcgcattgctgtgcaaccatcaccaccattcatctccaggaacctttttatcttcccaaactgaaattctgtacccattaagcaataactcccttttctccccctccctgttggtttataaaagttgactttatatagtttttgcttttatctgtttgttttggtctgtttttatccctagacatctggtgattcttggtcatcctttattttttattttatttttttgagacagagtcttgctctgtcgcccaggctagactgcagtggtgcgatctcagttcaccacaacctctgcctcccaggttcaggcaattcctgtgcctcagcctcccaagtagctgggattacaggcatgcaccaccatgcccagctaatttttgtatttttaatagagatggggttttgccatgttggccaggctggtctcgaactcctgacctcaagtgctctgcccaccttggcctcccgaagtattgggattacaggcgtgagccaccatgcccagcccgtctagttgtttttaataatgaccactaagaaactgcttgggaactcttaacacatggtggaatgtgtcaactttggggtacactgtgggccattttgtggggtaatatctgtatctttatggattttttttttttttttggtggactagttatagtctccagaaaagaatcttcagtctgcttgtatgggtgagacagactgctagcattctgggagatgagtggcaaagtgtgttcggagtctcatatgcagtatataattccatcttcaaattatgcctggagtccctgtgtctgcagactttccattttactcttttttgcattttacatttcactattttatctaaaggataaacttccaatcttgggtgggggagggtcacttacctgccatgtggagttaagtagggatctggagtctaactgcttcttaaactttaggccaccctattgagtcattgttcagacttattttgttgtgacatccccaaatatcactatctgttggttttttctccgtgaatgatctgttttcccccagggactagtcgccttcttgtgggtatagagcttcttgccagtcttatggaagctgagtggggaagggcctggaggggaattcacggtgtaaactcatttatcctcctggtatacccctgtgctcagctgtacatgatatactggactatcctgggtcatcctcctcagaaagtgaaactttcatcatctgccacggtaggagatggtatctaggagtttcactgcttcttattcagactttgagccagcgtttccttttcaacaccacccatactcctgactttcataggtatatgttgcctctgcttctgagcctttctgctttctgaggtcctatagctgctgcttttttttttggagacagagcttcactcttgtctcccaggctggagtgcagtggcgcaatcttggctcactgcaacctccacctcccaggttcaagcaattcttctgcctcagcctcccaagtagctgagattacaggcactcatcatcatgcctggctaattatttttgtatttttagtagagacggggtttcaccatgttggccagtctggtctcgaactcctgacctcaggtaatccatctgcttcggcttcccaaagtgctgggattacaggcatgggccaccacacctggccctgtgttctcatgtgtaaaatgaaggacggggaagggagaggagaccaaataccacttaagactgattccatattgacttaattataatttgctcatagcaaaataattagtttcatacagcagatttttaaaagagcaggtacttttgttctgtatagtcatgcaccagtagatatttagtaaatacatgtgaggtcagcatctcaagagggaagccacgctcctctgttaccagtcaaagactctgggtagccatgcaaggacaggactttatcaaatgctctcacccagtgatggttctggatctcaagtgaatataagaaaaaagaaccaacacaagcatacacacatatactgcaggaacacactctagaagtagatggaaatgaatgacagtcaaatccaaacaataacttcccctcaggatttaataaaatctaatattagcgaaggctctttagtctagaaagaaaggcaccagtcactgcaggtagagtggaagaaagactatgaaacagaagccaatattctaatttcagcttgacaacagtttactcagaagtgctgtattacctttctgtgtataagttttctctggggaaaaaaatggaggactgaacacatgtttacctcagttccctctccaaatcacactgaggttacagaaatcagtttttttttgttttttttttttttgagatggagtttcgctcttgtcacccaggctggagtgcagtggcgcgatttttggctcagtgcaacctccacctcccaggttcaagcaattctcctgcctcagcctcaccaggagctggtgtcaggtgtgaggattacaagcaatccttgcaccttggcttcccagagtgctgggattgcaggtgtgagccactgcgcctggtcgaaaatgattcttaagtttatttttctcagaggcaggtgtacagcaaatggctttttgttagactactcatgtcctccctcctctccagttttcattgtgatgaaaaccttggtcagataagatttcattgtgtccaatagtctaaattgaagtatatgtactctttttttttctcaattttctgccttagttactgtgaatatgtcttcatgaccttatttttagatagaaatataacttacttctcttctttacagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaaagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggtatgcacttttcctttattctccctcaaactccaagctcacatttgctgtgcattatccttgctaataagagtcctatttttttctcccactcatgaatatttctttaaaccagttagtctgcttgaagccttttatattgctgcattatgtagatgttccatcatttaatccttgtagacacttgcattgattccatttttttcataagctaatagtgcgatgaaattatgtctttacatttatacatttgtttctgtaagctaaattctcattattagaattgatggtgaaggaatattcacacttaaaattttaagataattaagttaccctccaaaaagttgaaccagtttacatttgttaagctttggcagtcttacagatcacagagttttgttttaatttgcatttttgagttttaagtttgaacatctgtttctgtgtttattggccacttttttgtatgtgcatggttttcctttgcctatttttcttttttttgagatggagtcttactctgtcgccaggctggagtgcaatggtgagatcttggctcaccacaacctccacctcctgggttcaagtgattctcctgtctcaaccccccgagtagttgggattacaggcacccgccaccatgcctggctaatttttgtatttttagtagagatggggtttcaccatgttggccaggctggtctcgacctcctgacctcacgtgatccacccaccttggcctcccaaaatgctgggattacaggcgtgagacaccgtgccctgcccctttgcctatttttcaactggattgtttctgtttttttttttttaatataggagacgctcaatgtaccaggcactgtgctggttcctaagaatgtagcaatgaacagaatatatgaccttcagggaacttggtgtcattctagtcataaaaatgtttaattgctgattataaatgtcataagaatggtccctcacgaaaggtaaaagccttcagtaccccaaaattgtttgatatttttgcttaataggagttttcagttcttacatagtaaaacttatctgtctttttttattttttattttttggagatggagtcttgctctgtcacccaggctggagtgcagtgacgcaatctcggctcactgcaacctctgcttcccggttcaagcagttctcctgcctcagcctcccaagtagctgagactacaggcacacgctaccatgcccggctaattttttgtattttagtagagacagtgtttcaccatgttgcccaggctggtctcgaactcctgagctcaggcaatctgcccgcctcggccagtctgcctaaagtgctaggattacaggcatgagccactgcgcctggcctaaagcttacctatatttgactttgaggcttctagtttttacgtcatgctttaagaagccttctcttgtcaaaaatctatcccataaggtaaactggtgtaaacatttctttggaagacaatatgatagtataaattatggcccattcaggcaatagtttgctagcagctgtttaagaatatagatctatattttgatactgaaagatgtctatataaagtgaaaacaggccaggtgctgtggctcacgcctgtaatcccaacactttgggaggccgaggtgggcggatcacctgaggtcaggagttcaagacgaggctgatcaacatggtgaaaccccatctctactaaaaatacaaaaatcagccaggtgttgtggtgcgtgtctgtgatcccagctacttaggaggctgaggcagggagaatcgcttgaacctgggaggcggaggttgcagtgagcttaggttatgccaccgtgctccagcctgggcgacagagcgagactctctcacaaaaaaaaaagaaagaaaaaaagtgaaaacagtaagttgcaaaatggtatgaaaccattttgttaaaagatatatatgacatatgtaggatgagtgtgagtatatatgtgtgcatatgcatttgtataggacatctggacagatattattaccattggctttggggagctagttaggaggtttatttcttggtagttgaaacagttctgagcactttctctttccaaccattaagtataataaattcttctggctgggcacggtggctcatgcctgttatcccagcactttgggaggccgaggcgggcggatcatgaggtcaggagatcgagaccatcctggctaacatggtgaaaccccgtccctactaaaaatttaaaaaattagccgggcgtggtggcaggcgcctgtagtccccactacttgggaggccaagacaggagaatggtgtgaacgggggaggcggagcttgcattgagctgagatcgtgccactgcactccagcctgggcgacagagcaagactctgtctcaaaaaaaataaaaataaataaattagtaaataaattcttcctcatagaaagacacaaagtacagagtcctagcaaattaaaaaaaaaaacaacaccaaaaaacctcttgtctatactgtcctagagtaaagccagatttccctactgaggttagcagacccatgatacttacacctgaaaagaattagcatttacccacaaatgccagttaacctttatagatgtaacactttcaagtacggttgataaattgaatatgcacgtagtaaaacctgtagcatgacctgaggaagtaggaattcttacagaattcatgtgtagtgacaatataattcactattttaataggccaaaggggaaaaaaatggtatctcagcaagtgctgaaaaacctgttagtaaaattgtttccttttgggtttaaatctcttagaaaactagtaataaaggaagcttccttgaattactaaagaatatcaatcagaagccaatagcagtttcaggtttaagagaatgaagtaagctcatggactctcttcttcctcctaccaaatccatagaaattatgaaaaaatattaaaaacacatgtgtcttcatactcacaaatgaggagacagttttggtagatcagaaactgagaatcagctcccactgggcaaaaagtagagggaaggtccaggcgggcagaaggaagattagtacagggaagtggtgtgatactgagtgctcatatttctggagatggtggaagtggagaggaaaggggacacccatggtaaggactgagtagttggggaatctctccctgcctgtgccacatgtcagcaaagaacaaatctgttatcaagccaaaattctaaggacaagagacaggatactcacccacacacgtacaccttgtaacacttggcaagagtgaggaacatccattttcagaacagctgctggggttcttagtgtccttattcccactgaaaatagttcaaggcagagcagcagctactgcccattatagccctttgccctcaattctcagcaagttacctaagtagagatgaactaacagtctatcaccatcctctgagaaaagccaacacaatgaaatagacaaattcagcaaataacagaactaaacctcagtattgattaatggggcaatgagtacaatagataatcctttaagggacttctacaacattagccactattgagttctgtggggtgctgaatgctggcttgtctctaatatgactgcacattatgctcctttcagttgatttacatgtttaagagtcagttatacttaggggagatttacttgttgcagtttcataattttattcagtattacataaaatgatgaaatatgagtgtaagaagaaagctcctcctttgaaaaacaaggtgaatactttgcaatgacagtagcgggttgctgcaaaaaaatgaatgctgatgcgctcatgcaggacagctgcaaaagatttgagggcgtgcgtgaaagtctaggactctgcactgagattactttgcaagttctttaagttcttgcttcgctttaaagttctaacctctatgtcatgagtatgccaggagataatggaagggaaactgaagaaattaggaatgttttctagaactgaaaagaaaggtctgagtctaaagttgaaaggctttgcaagtgccaatcaggattaaaacacacaaatacatacacaaactcacactaaatttagtgtagtaaaattatagcacatccaagagaaataacttggatggttacttcttttggagggaaaagggatagattcctgtgccgcaaaacattccagatggattaaaagtttggctaattaaaaccaaatacacagaaatgtgtacacgaatgcttgtaacagcattgttcataatatccagaaagtgaaaacaacctaaatgttcaacacctgatgaatggataaataaaatttggtatatctatacaatggaatattattctataaaaggaataaacaccgatatatacttaaatgtggatgcaccttggaagcatgctaagtgaaaagccagacacaaaaggccttataacatatgatttcgttcatttgaaatgtccagaataggcaaatacatagagatataaagtagattaatagttgccaggagctgggaagaaggggaatgagaggtgactgttaatgggtatagagtttctttgtggggtaatggaggtgttctggaattaggtagtagtgatagttacacaatctgaatatattaaaaaacagtgaattgtgttctttaatggggcaaattttgtggtgtgtgaatcacatctcaataaagctgttaaaaagaaacaaatataggccggccatggtggctcacatctgtaatcccagcactttaggaggctgaggcagaaggatcgcttgagggcaggagtttgagaccagcctgggcaacatagcgatataaatacatagagggatgtatatagatttagcgagactctattgctacaaaaaataaaattatctgcatgtggtggtgcatgcctgtagtcccagctcctcagatggatgaggtgggaggactgcttgaagccaggagtttgaggttgaagtgagctatggtagctcgactgcattccacgctgggtgacagcaagaccttgtctctctcttttttttgagacggagtctcactctttctcccaggctggagtgcagtggcgtgatctttgcttactgcaacctctgccttctgggttcaagcgattctcctgcctcagcctccggagtagctgggactataggcatgtgccaccacgcccggctaattttttgtatttttagtagagacggggtttcactgtgttagccaggatggtctcaatctcctgacctcatgatccacctgcctcagcctcccaaagtgctgggattacaggcgtgagtcaccgcgcccggccgaccttgactcttaaaaaaagaaaaaaaaaatacaggaaatcattctttttaagtttttggtttctttgtttgtgacagagtctccctctgtctcccaggctagagtgcagaggcgtgatctcagctcactgcaaactccgcctcccgggttcaagcgattctcgtgcctcagcctctggagtagccaggaccacagaggtgcgccactatatgcctggctaattttttgtatttttagtagagatggggtttcaccatgttggccaggctggtcttgaactcctcacctcaagtgatccgcccggcttagcctcccaaagtgctgggattacaggcatgagccactgtgcctgacctaaagattatttttaattgacaaaattctatatatttatggggtacaatgtgatgttttgatatatgtttactttgtgaagtaaatcaagataatcagcatatccatcactcacttcgtcgtgagaacatttaaaatcaattctcatctattttcaagacacagtacattattattaactatagtcaccagactgtacaatagatctctaggaccacttcctcctgtctaacggaagctttatgacccttgaccaacatcttccaattctctgccccacccccagcccctggtaactaccgttgattctctacgtctatgagtttgactttagattccacatgtaagtgagatcatgcagtatatttttttgtgtctggcatatttcacatattatgctccagattcatccatgttgcagatgacaggatgttttaaggctgaattgtattccattgtgtatatatactacattttctttctccattcatccactcatgggcattgaggttgatgccatgtcttggctattgtggatagtgccgcagtgagtatggggtgcaggtacctcttcaacacactgattttattgtctttgaaatacactcagaaatggaattgctggatcatatggtagttctatttttaattttttgaggaacctgtatactgttttccttcatggctgtgctaattcacattcccaccaacagtgtacagggttcccctttctccacattcaagtcctttgcctgctttttaaattgggttatgttcttgctattcgttgtttgagcaggagaccatttttataatcttatattgataagacatttttgcccataataggaagctcagaagcaatgaaaatataccaaattgactctacagacatttaaatcttgtgtgcatgtgtgtgtgtatagcaaaagttagatgaaaatttaaaaatttagatatgcatgcccttttacccagaaatttaacttgtagtaggtgtgtccaagggaaacagtagaactaggatagatcaagagttttaattgttacattatttagaggtaaaaataaatggccatcagtagggaattggttacaatacagtatgcattttttcaggcaaaagagaactgtccatgatatagtgaatggaaaaaagcagcttcaagaagagtaagtttaggccgggcgcggtggctcatgcctgtaatcccagcactttgggaggccgaggtgggtggatcacctgaggtcaggagttcaagactagcctgaccaatatggtgaaactccgtctctactaaaaatacaaaaattagccaggcatggtggcatgcgcctgtagtcccagctacttgggaggctgagacaggagaattgcttgtacttgtgagttggaggttgcagtgagttgagatcgcaccactgcactccagcctgggtgacagagtgagactctgtctcaaaaaaaaaaaaaaaaaatttagtgtgtttaagaaatacatgttcaaagggcttgaaagtccagaaggaattatgggctcactgccatttatttaaaaatatttatggtcgtgtatgagaaaaaataactacttaaaaggttgtttccacatataaagtaaatgtttataaaaatgtccaactctttttttctagatattaatgtggtttttttttttttttttttttctggagacagagttttgatcttgttgcccaggctggagtgcagtggcgtgatctcggctcacggtggcctccacttcctgggttcaagcaattttcctgcctcagcctcccgattagttgggatgacaggtgcccgccaccacgcccggctaattttgtatttttagtagagacagggtttctccatgttggtcaggcttgtctcaaactcccaaactcaggtgatccgcccgccttatcctcccaaagtgctgggattacaaatgtgagctactgcccccggcctaatgtgttatttttaatttagtgctttggaaaaaagttaaggtagatccttacctcattctttacaccaaaatgaattccagctgttaataaaatatttagttgcgagttctttttttttttttaaatttattcccatgggtctgggaaccaatgaaattagttggtagttctaatactgtttattgagtgatttgctcttttccctgtggttcagaaatgcaacctaccacagagtctctttggatttgatctctattccatgctggctctatttgccttaattagcgtagttttatcatttgacaggacctggcgctccttattcacctctctcctttaattcttttcaaaaatttctaggaatttctcacatttttgtcccaaggtaaattttggatttattttgtaatcttttaaaaaagtatggtttttacttgttgttgcattatatttatagattaatttagggacagttgctttcattgcaaaagacttcctgtcccttagtcatatttcgcatcttttcacttaggttttgcgcattgcttatgtttgttcttagatactgtataccttccttactgctgatgggcccgttctgaggtatgcactgtgttttgttggagaaccatgtgcttgcatttcttacgtgcacagcacggggaacctcattccacatccagggtggaatgtgacccaggtcagttgcatcaaacgaaaactgtccagtgccgttagtttaacatgatggctacttttaacttctttttttttttttttttttgagacggagtcttactctgtcacccaggctggagtgcagtggcataatctcagctcgctgcaagctccgcctcccatgttcacgccattctcctgcctcccgagtagctgggactacaggcgcccgccaccatgcccggctaattttttgtattttttagtagagacagggttccaccatgttagccaggatggtctcgatctcctgacctcgtgatccacccgcttcggcttcccaaagtgctgggattacaggcgtaagccaccgcgcccggccttactttaacttcttttttttaaaaagttcttttttattttttcagttatttttgaggcagggtctcgttctgttgcccaagttggagtgccgtggtgggatcttggctcactgcagtctttgcctcccaggctcaacccatcctcccacctcaccctcccgagtagctgggactacaggcatgtgccaacatgcttggctaatttttgtattttttgtagagaagcggtctcactttgttgcccagactggtcttgaacttctgagcttaagcaatccttctgtctcagcctcccaaagtgttaggattacaggcatgagccaccgtgcctggccgggtactttaaattctaaaatgacacctcaggttttgttttttatattactaccttttgtacttgcagagtgctctgtaatttgaactccagtttttgtttgttgtttattcctaacattttatcctttgtttcttgggtcactttgaaattttagtactttgggagtaaaataaattgtgtataccaattgcatttttccttttttagttgatcagtttagtgaaagcaagtgggtaaagaatggtggatttaactgtcattttataaaatctgtttctgagtaaaataaattgtatataccaagtgcatttttccttttttaattgattagtttaatgaaagcaagtggataaagaatggtggatttaactgtcattttataaaatctgtttctggatagttcttggcccacagatattaaaaaggaaaggtgaagaaccaagttgtttttgtagagaaaagataacagatatttcttgctttgtaagtggcatgacatgatagttaacagcccagtttctgtagtcacggtacctacaatcaggatcttagttctaccatatgctagttaagtgcccttggggaggtaacaacctctcaaagcttctaatgtctccatttgattgactggttgattgattgattgattgagatgaggtctcgctctgttgcccagactggagtgcagtggcataatctcggctcactacagcctctgcctcccaggttcaagcgattttcctgcctcagtctcccaagtagctgagattacaggcacgctaacatgcccggctaatttttgtagttttagcatagacagggtttcaccatgttggccaggctggtcttgaattcttgacctcaggtgatccacccgccttccaaagtgctgggattacaggcatgagccaccgcacctggcccagtgtctctatttgtaaagtagggatactatcttaacacccagggaggctataagaactaaatgagacaggctagtgcttgtcttatgagtattttttaactgttgttttacttctggtcccagtgagataatggtgtgtgtaagtgagacactgtcatctagggttctccttgaagatcgtaccttgaagggcatttctaccgaataagaaatccatgtttatcatctgaaaatgaaaataaagatacagataagaggaaaatgtgtaataatttagaatctccatcattctaccaccagaaataacattgttaacaagagcaccatgatactagtttgaaattcacatccatatcccattgtgggggacactgccttcttatttgaggagcctcaatcaaagttgtggggcctaaagtttaatttttattgttgttaggggtattattttacaacgaaaaataattctcaatgcagtttctcaaatggtgggattccttatcttccactgggcccattcccccatgtagacacaaggttatgattaggtaactgtaagatgtgaaatagtaaacactagaggcaagtatatggtctgttcctagattagaagccccaaatctttatctgataccctgatgaagttggagcatgggactatcttcctgtctactgtatttgcccaaagcctagagcagaatggacgtgagaaaggacctcttttctgtttactgtaccctgacctttgctcctatgttaagccttgaaaattgagaggtactctggtgggagattaacaggaggaaaaataaattgttcacttctttgtctgtctctcccctcataaaagacaaaacacttcattcccaagacactcttatcatcttttctatcctgtttatatcaatgcatggcagaggccattcttggagttacaaagggagctggttaagatatgtggctaacaatcctcatttttcctgtcttaactcagcagacttaaccgtcagactgatggttagctaatttgttgctctgcccattcagcattggtgaacaacctaagtcatgtctgtacttctgtgagcgtctaagccttgcctcagcttttttgtatttacttagaaataatgtcctgggtggccaggcgcggtggctcacacctgtaatctcagtactttgggaagacaaggcaggtggatcacctgaggtcaggagttcgagaccagcctggccaacatggtgaaaccccgtctctacaaaaaaaaaaaatacaaaaattagctgggcgtggtggcgggcgcctgtaatcccagctactcacgaggctgaggtaggagaatcacttgaacccaggaggggtgggttgcagtgagccgaaatcgcaccattgcactccagcctgggtgaaaagagcaaggctttgtcttaaaaaaaaagaaaaaagaaaagaaagaacgtcctgggtttatttcctggggcttttctaggttcagtggatcattcagggatatatataagcacatatacatgttacttacatttacctgaagactgtcctatggtgtggccaaaaagccacctttaaattttatttctcatcttgggaggctggagcgaaaggatcacttgaggccagaagttcaagaccagcctgagcaacatagcaagaccctcatcttaaaaaaaaaaaattaaaaaattagctgggtgtggtttcacttgcctatagtcccagctaactatccaagcaggaggatggcttgagcccaggagtttgaggctgtagtgagctatgattgtgttactatgccccagctgggatgatagaaagagaccccatctccaaaaaattctatttactgtcttaaaatgtgcttcactagctgggtgtggtggctcacgcctgtaatcccagcactttctgaggccgaggcgggcggatcacaaggtcaggagatcaagaccaccctggctaacacggtgaaacccctcgatgatagttccattcgattctatgcgatgattccattccattccattggaagatgattccattcgagaccattcgatgattgcattcaattcattcgatgacgattccattcaattccgttcaatgattccattagattccatttgatgatgattccattcgtctctactaaaaatacaaaaaaattagccgggcgtggtggcaggcgcctgtagtcacagctatttgggaggatgaggcaggagaatggcgtgaacccgggaggtggagcttgtagtgagcagagatcgtgccactgcactccagcctgggcaacagagcgagacgccatctcaaaaaaaaaaaaaaaaaagtgcctcactagctgttatccagttgagctcacctcacagcgttatttggtgtcatgagtataataacttatcaagatgtatgatattgtcccttgctgatactaaagtacatacctttaccaaataatagagtcacagtgatctcatcagttaatgctaattgtgattttaaaataataattctttcagttaccaaaaggataggcacatttgactatgtgattaagccctttagaagtcacgctttaagagaaggttaagctgtgggaagctgttagtatttccttctagctatccattccttctctaacaatgcttcagtaacttaaaaatctaatgtgaaatgattcctcacagtatgtctctctagattgcattggttagagcctaatatattttattttttacaaaagacataactttaaaaatatagtatcaatattatatagtaatataggttaaccactgtatgtgttaagtgctgtgtataggttaagtgtttggagaatgactctactgaaaatggcttgtttttccatcttaacttttctttcttcctttatttaaggattcctagatgaggttatgaagaagtatggcagtttggttccactcagtgaaaaagaagtccttggaagattaaaagatgtctttaatgaagacttttctaataggtatataaatgatgctaaagttaagcccttgaaaataaaatttttggcatatatgacttttctcttgatttacagaagaaaagatatttagcagtaaattgagaagtactcatgttttttttaccttttgtttcaaaatctttctctttcagaaaaccatttatcaatagggaaataacaaactatcgggccagacatcaaaaatgtaacttccgtatcttctataataaacacatgctggatatggacgacctggcgactctggatggtcagaactggctgaatgaccaggttagtatattgtagtttttcagtgtggagaagttgcagaggatgttagtcaataaaatataatctctagtttggcttctcagttgtcttttggaataaggattcttcattctttactggttacttgccccaggatccaaacggtttgattactattggcagtaataatatattatttattctgattgggatgtactgaattgtatagggttagtagcctggttttatttatttattttgtttttctttctccaacttaactggcagagatagtaagctggttttatgttgactttttataggtcattaatatgtatggtgagctgataatggatgcagtcccagacaaagtaagtgaaaacttcctcttctgcaggagagagtgttcttgtgtattaaaatgagtagtttttttgtttttacatttgatgtaattatctgacattccttaaattttttaaaagaagagttcaattttttcttgatcatgtactgggcttgatcgtaagttccatcaaatcacttctttttgttctttttgagatggagttttgctcttgttgcccaggctggagtgcagtggcgtgatctcggctcattgcaacctccacctcccgggttcaagcgattctcctgtctcagcctcccgactagctgggattataggcatgtgccaccatgcctggctaatttttgtatttttagtagagacagggtttcatcatattggtcaggctggtctcgaactcctgacctcaggtgatccacctctgccttggtctcccaaagtgctgggattacaggtgtgagccacagcgcctggccccatcaaatcacttcagcataagaaaatcactgtgcaattgttttcctatttatttgtgttagggtaggtatgtttgttgatatctggagagggcctttttttggtggggagatgtgcaaaagggactggctaagctttttacatttatgtatttattttacttttttttttttttgagaccgagtcttgctctgtcatccagactggagtgtagtggcgtggtcttggctcactgcaacctccacctcctgggttcaagcaattctcctgccttagcctcccaagtagctgggattacaggtgtgtgccaccatgcctggctaatttttgtatttttaggagagacaggtcttaccatgttgggcaggctggtctcgaactcctgacctctggtgatccgcccacctccccctcccaaagtgctgggattaaagatgtgagccaccatgccaggccagctttttacatttaacttaaaatcttgctctctttaaaaatgtaaaaaaaaactcatctttcatttttccttagataaatctttgatactcagttcaaatacagattgaaccctcataaactctaaattctcttaagagttttgttacatatcaaaactatttttttacttaatgtatttttctgagtacacaaatgcctgatgggtgcaaaaatttccaagtgctgtataaaacttaccaatctaataaagtaacataaatactaaaaagtcagattctgataccgtttatgaatatagaaaatgttttatgactttccacttaaattataaatctgttatacatttataaattggaatcatgaggctaatctgctagatgctctattgtcaaattctcttaatcatcagaaagtttaaacaatatagattatctttaacataaaagtattaatttcaagggtttcatttaccaccattgtacatttaattctaaacattcatggagtcaaaaggacacttaactaaggcagtggttctcaaagcatggtccccatactagcagcatcagtatcccctgagaacttactagaaatgcacattctgagactccatcccacacctactgaatcagaaactggaggtgggggaccaccgatttgtgttttgacaagctctctagatgattctgatggacaccaattttgagaatcactgctctagagacagctactataagctctttcttatttatttgtttttattaaaattataaaacataaccttctttttagagacactaaaaagacactccaggctggaatgcagtggcacagtcatagctcactgtagccttgaactcctgggctcaagcaatcttctcgccttagcctcccaggtagctgggactagaggcatgtgccactgtgctactatacccagctagtttatttttatttttggtagagccaggagtcttgctatgttgcccaggctagcttgagctctgggcttagctaaagtaatcctctcacctctgcctctcaaaattgctgggattagaagtgtgagccactatgtctggcagctctttcagtctgtatgttaagctgcatggttatcaaaagaatgtgcctcagaaccgtctgaaaggtttataaaaccagattactgggccctgccttcagagtttctgctttaataggtctgggatgaggcctgataatttggatttctaacaagttcctagatgatgctgacactactggtcaggtgaccacactctgagaaccacagtgctaagggaacagttttatcacctcaagttactgaatgagcactttaagatcacaatatgtttaccctctaagatgagctgatataccacttacttataagtcagaaattcaaagccaaggacgcaggacctgatactctgtacagccagggtaattctgtggtactagaaataatcatgccaaggcctttttatggttactgtaacaacaggagtctctaaatccacatccttcacatggagttagttttgtaatccatctcccttgagttcaaggtaattgttacctcattttttcatagcctctttcagctttttcacctgatttagagagatttgtcaggttgcttctctacttgattggattcaggtagtctatttactgccccattccaaagctgactatagaccacagctgtaaggtcattccaataaaactttggaacagcattttctgtaaaccatgtaatgtattttctatattttgatcattattatcattattattattttttgagacggagttttgctctggtgcccatgctggagtgcagtgatgtgatctcagctcactacaacctctgcctcccaggttcaagagattctcctacctcagcctcctgagtagctgggattgcagatgggtgccaccacgcccggctaatttttgtatttttaggagagacagtgtctcaccatgttggccaggctggcctcgaactcctgaccccagatgatccacttgcctcctcaatcattgtttttatgaagaaatttttccttcctttttgtctgctttacattcaaacattttaaaatttcctcttttgaagttaaatctgggcacagcctaatataatctggttgcttgtgtttgttgtctgttctaggttcacttcttcaacagcttttttcatagacagctggtaaccaaaggatataatggagtaaaaagatggactaaaaaggtattctctttatttcttttttattccaaatttgaaacgcagatgataaaccactttgtgtggaaggataagtactttaatgccaatacgatgttaagtagaaacagactttttaatgtgacaagttttaaatttgtttcttttaaatcttattgtttgaaagaccttaattgcctactggtcccaattatagtggtagaacagtgggatgataaagaaggagctgccatcatttggtgttatctggtaggcttgtcagcagacagcagaagctttcaacaattttttgctggtgctgggcacggtgcctcgcacctgttgtcccagctacttgggatgctgagaccagaggatcacttgagcacaagcatttgaggccagcttgggcaacatagccagatcctgtctcttaaaatgttaactgatccatcaggagaaataacttttatatcacaatctattcataaaatcttatacatacatgtaattgaaataatttccaaaaaccatgtacctaatttactatgtatgatgtactctagtcagagagtggtaagtgctatttgctatggaaacatcagaacacagtatgagaatacaaggtaactgggatagggtagcaggaggaagatgggctagttcttttagataggcttgtcagcaaaggcctctttgaagagatcccatttcactgaaaactgtgaagatcagaggagcattcccagtagatggaagagtgaatgttaaaggccctgaagcagaagtgagtttggtatattggagtattacacacatgagatcagggaaggaggcagggatcaagtcatgtggcgccatataggccctggtaaagagtttggatcatgagggcaatttgaagacattagagagtttaggccaggtgcggtggctcacgcctgtaatcccagcactttgggaggctgaggtgggcggatcactgaaggtcaggagtttgagatcagcctggccaatgtggcgaaaccctatctctactgaaaatgcaaaaattagccgggctgtgatggtgggcgcctgtaaccccagctacttgggaggctgaggtgggagaatcgcttgaacatgggaggtggaggttgcagtgagccgagattgcactattgcactccagccttggtgacagagcgagactccatgtcaaaagaaaattaaataaaaaataaaaatgaagacattagagggtttaagcagcaggcaaggagtgtgtatgagtgtgtgtgtaaatgatagataggattgtccttagcaacattgattcattcattcatcatttatttattgatttattttttgagatggagtctttcaggcgctatcttcgctcactgcaacctctgcctcctgggttcaagcgattctcctgcttcagcctcctgtgcagctgggattacagtcacctgccaccgtacccggctaattcttgtatttttaatagagacgggatttcactatgttggccaggctggtctctaactcctgacctcaggcaggtgatctgcccgcctcagcctcccaaagtgttgggattacagggtaagccaccgtgcccggcattaaacatttattgagtacctgttatgtgcctatatggaaaaacttttttcctttgctgtcacaccacaacagtagtcagcacagaagacttctgtgaccaaagcaagcaagcaagcagttctgcagcgaccactggctggatgccctctaattcaattccgacctgtctacctggagacagtgccacgtcccatagtttgagggctcatgcctcaagagtgccccccacccacttcagacaccagttgcaagtccaggcttctgaaacttctgaccaacagacttcaagtgagggttcccatgccgccctccttgaatttgattaatttgccggagcggttcacagaattctgggaagttcttacctacatttagcagtttattatataggatattacaaaggattcagatgaagagatgcatgggaagagatgtaggggagtgggcacagggattctctaggacctccacaggcacatcaccctccaggaacctccacatatttagtatccagaagctctcccagtgcagtcagtttttatggaggcttcattacataggcgattgactaaaccagtgaccattggttaacctttagcttctcttctctccctggtggttggggggttgggtggggctgaaagtcacaatcctctaattctgccttgctcttatcctaaagccacctagcagctgccagccatcagttaatcatcaacatacaaaaagacatcactttgggcctgggtcatgtccccgtaatcccagcactttggaagtctgaggcaggcagatcacttgaggtcaggagttcaagatcagcctggccaacatggtggaaccctgtctctactgaaaatacaaaaattagctgggtatggtggcatgtgcctgtagtcccagctacttgggaggctgagacaggagaatcgtttgaacccaggaggtggaggttgctgtgagccgagattgcaccactgcactccagcctgggtgacagagcaagactttctaaaaaaaaagaaaaaaagacatcagaaattccaaggactttagggagttgtatgccaggaaatgaggtcaaagaccaaatttattattttacagtatcatagtgccagacattatagtaaatcaagaaataaagaggtaagtaaaacaatattagagacagtttttgctttcacaaagtctgcagtctagtggtggagacagcacctaccacagtttgtatttatatttttggtggtgtaattatttgtttagtgggtacaaaagaaaagtactacaggagtgtattggaatgcaggtttggttaacctagcctgagggtaagggaatgtttctcataggaagtaatatttaagcagaaatatcaaagatgaatacaagttaactaggtaaatggagaataggggtatgtgaaacataggcagaaggaataagtatctggtagaagaatgggaaaaggctagtgtagctgaaatgcagagagttaagaagacagtggcatgaagtgtacctgatccacagatcagggccttgaggtttgtattttggattttatcctaaatgtaataggaaaccattgaatggtttttagtgacattatccactttgtagtctttgttctaacagtactgaagaagatggatgggtatgggagcaaagttgatgtgggcagaacaggagaccatttcagattcatggtactttgaagtagaatgatagcaggagagatggaagatgagtgtgatgtaggaagtaaaattaacaggatttggtgataagttggttatggagatgaaggacaaggaagtgtgaaagatgacttccaagtatgtgacttgtatgactggacggcctatggttgtatttacattagaaaaatgtaggacaactagtagaggattgttcaaatttaaaatgtacagtcatataattggatgctacttaagcaggaaaagctgtgtagataatgaacgatgggccgggcacagtggctcacatcagtaatcccagcactttgaggggccgaggcaggcggatcacgaggtcaggagatagagaccatcctggctaacacggtgaaaccccatctctattaaaaatacaaaaaaattagccgggcgtggtgacggatgcctgtagtcccacttactcaggagactgaacccaggaggcggagcttgcagtgagccaagatcgcaccactgcactccagcctgggcgacagagagactccgtctcaaaaaaaaaaaaaaaagataatggaagatgcttatattccatttggggtgggaaaaattacaagcagtgtgggcaaaaaatatacattcatggaaaagtatctgaatgataaacatgagagtgaaagaataaagtcaaatatgtgagttgtttcattaaataataaactaaattattccttcctctagatcaggggtgtccaatcttttggcttccctgagcctcactggaagaagaagagttgtcttgggccacacataaaatacaccaacactaacaatagctgatgagctaaaacaaaaaaaattgcaaaaaagatctcataaaagaaagtctacaaatttgtgttcggctgcattcagagccgtcctgggctgcatgctgcccgtgggctgtggactggacaagcttgctgtagatcctctgagattgggttaagtaaaaaaaaaaaaaacccaggtttatgctgaatataagaagtatacataaaataatatgaaaaagaaaggttgaaaatgaagtgacatttaaagaggctgggcgctgtgtctcacatctgcagtctgaacactttgggaggcctaaaattactgtagatgggaggattgcttgagcccaagagtttcaaatcagcctaggcaaccaagcgagaccccgtttctataaaaaatttaaaaaacttagctggccatggtggcagcctgtggtcccagttatccagaaggctgcggtgggaggatcacttgagcctgggaggtcgaggctgcagtgaaccctgatcacgccactgcactcctgcctgggtgacagactgagaccttgtctcaatttaaaacaaataaaaaaggcaactacaggaaagttaaacaacctgttcctgaataactcctgggtaaataaagaaattaaggcagaaatcaagaagttctttgaaaccaatgagaacagagagacaatgtaccagaatctctgggacacagctaaagcagtgttaagagggaagtttatagcactaaatgcccacatcgaaaagctggaaagatctcagatcaacatcctgacatcacaattaaaagaactagagaagcggctgggcgtggtgactcatgcctgtaatcccagcactttgggaggctgaggcgggtagatcacctgaggtcaggagtttgagatgagcctgaccaacatggagaaaccccatctctactaaaaatacaaaattggctgggtgtggtggcacatgcctgtaatcccagctacttgggaggccgaggtaggagaatcacttgaacccgggaggtggaggttgtggtgagctgagattgcgccattgcactccagcctgggcaagaagagtgaaactctgtctcaaaacaaacaaacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggattttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacggataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctgaaactatttcataacaattgaaaaggaggaactcctccctagctcattttatgaggccggcatcatcctgataccaaaacctggcagagacacaaaaaaagaaaatttcaggccaatatccctgatgaacatcggtgcgaaaaattctcaataaaatgctggcaaaccaaatccagcagcacatcaaaaagcttatccaccatgatcaagttggcttcatccctgggatgcaaggctgattcaacatatgcaaatcagtaaacataatccgtcatataaacagaaccagtgacgaaaaccacatgattatttcagtagatgcagaaaagaccttcgataaaattcagcatcccttcatttaaaaactctcaataaactaggtattcatcaaacatatctcaataataagagctatttatgacaaacccatagccaatatcagtgggcaaaagctggaaacattccctttgaaaactggcacaagacaaggatgccctctcccatcacttctattcaacataatattggaagttctggccagggcaatcaggcaagagaaagaaatacagggtattcagatagaaagagaggaagtcaaattgtctcttgcagatggcatgattctatatttagaaaatgccatcgtctcagccccaaaaccccttacgttgataagaaactttagcaaagtctcaggatacaaaatcaatgtgcagaaatcacaagcattcctatacgccagcaatggacaagcagagagccaaatcatgaatgaacccccattcacaattgctacaaagagaataaaatacctaggaatacagtttataagggatgtgaaggacctcttcaaggagaactacaaaccactgctcaaggaagtaagagaggacacaaacaaatggaaaaatattccatcctcgtggataggaagaaccagtatcttgaaaatggccatactgcccaaagtaatctttttttttttttttttttttttttttttgagatggagtctcgctccattgcccaggctggaatgcagtggcatgatcgtggctcactgcaacctccacttcccgggttcaagcaattctcctgcctcagcctcccgagtaggtgggactacaggcatgcaccaccatgcccagctaattttttgtatttttagtagacacagggtttcgccgtgttagccaggatggtctcgatgtcctgacctcgtgatccgcctgcctcggccttccagagtgctgggattatagatgtgagccaccactcctggctgcccaaagtaattaatagatttaatgctattcccatcaaactaccattggcattcttcacagaattagaaaaaactactttaaaattcatatggaaacaaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaactatcatcagagtgaacaggcaacctatagaattggataaaatttttgcagtctacccacctgacaaagatctaatatccagaatctacaaggaacttaagcagatttacaagaaaaataaaccatcagaaagtgggcaaaggatatgaacagacacttcgcaaaagaagacatttatgtctgtagtctcagctactcgagaggctgagacaggagaattgcttgacctgggaagtggaagttgcagtgagccaagattgcgccactgcactccagcctgggcgacagagtgagactttgtctcaaaaaaaaaaaaaaaaggacatttatgtagccaaaaaacatatgaaaaaacctcatcagttgggcgcggtggctcacgcctgtaatcccagcactttgggaagctgaggcagttgtggtggtgggggcctgtaatcccagctactcgggaggctgaggcaggagaatcgcttgaacctgagaggcagaggttgcgtgagctgagattgtgccattgcactccagccttagcaacaagagcaagactccgtctcaaaaaaaaacaaaacaaaaacagctaatcactgatcattagagaaatgcaaatcaaaaccacaatgagataccatctcatgcgagtcagaaatgacaattattaaaaagtcaagaaacaatagaagctggcaaggctgtggagacataggaatgcttttacactgttggtgggaacgtaagttagttcaaccattgtggaagacagagtggcaattcctcaaggatctagaaccagaaatatcatttgacccagcagtcctattactgggtatatacccaaaggaatataaatcattctctatagagacatatgcgtgtgtatatttattgcagtactcatagcaaagacatggaaccaacccaaatgcctatcagtgatagactacataaagagaatgtggtacatacgcaccatggaatactatgcagccatttaaagaatgagatcatgtcctttgaagggacaaggatgaagctggaagccatcatcctcagcaaactaacagaggaacagaaaaccaaacactgcatgttctcactcataagtgggagttgtacaataagaacacatggacatagggaggggaacaacatacaccggggcctgtcagggggttgggggcaaagagagggagagcattaggacaaatacctaatgcatgcagggcttaagacctagatgacagcggggtgcggtggttcatgcctgtaatccagcctgggtgacagagcaagactctgtctcaattaaaaagaaaaaaacaaaactagatgacggattgataagtgcagcaaaccaccacggcacatgtatacctatgtaacaaacctgcctgttctgcacatgtatcccggaactttaaaattttttgaaaattcaagttttcattaaaagaaaaaataaaaggtactaggcagctgggcgtggtggtgtgtgcctgtagtctctgctactccggaggctgaggtgggaggattgcttgagcccaggagtttgagactgcggtgagcagtggtcacaccactgtaccccagcctgggtgacagaccttgcctctaaaaataataatttgtttgaaaattgtagaaatttaaaggtactagacaaattgaaacaaaaacagaaaggaatattaatcatattaatagcagttgaaatagaatttaaggtgagaagcaaattgtgtaattatcagatttcaatataaaggagatataatgaccaatctttatgcaccaaagcacacagttgctaaatatgtgtaatacaattaaaacagaaacaagaggaccttggtaaaatagtgatagtggcagacttttctcataagtggataaatctagtagacaataaagacatatacaaaaattacagtcaatataattgatttaatagatgtttatgctccttaagagaatatacatttattgctatggttcaggaatatttgtaaaaattgaacatgtacttagccacaaagaaaattattttttattagccgggcaaggtggcatttgggagcccgaggcaggtgaatcatggggtcaggagttcaagaccagcctggccaagatagtgaaacctcttttctactaaaaatccaagaaaattagctgggtgtggtggtgtgcgcctgtaatcccagctattcgggaggctgaggcagagaatttcttaaacccaggaggcggaggttgcagtgagctgagatcatgccactgcactccagcctgggtgacagagtgagactccatctcaaaaaaaaaaaacaaaaaaaactagtaagaccctgaactcagtagaagactcagtgatgaaaaggtttataagaaaggcttttttttttttttttttttttgatggagtgttgctcttttgcccaggctggagtgcagtggcacaatcttggcttgctgcaacctctgcctcctgggttcaagcgattctcctgcctcagcctcccaagtagctgggattacaggtacacaccaccacacctggctaatttttgtatttttagtagagacaggttttgccacattggctaggctggtctcgaactcctggcctcaagtgatctgcctgcctcagcctcccaaagtgctgggattacaggcatgagccactgtgcctggccaagaaaggctcttaaacatataaaaagttgcataacttcacagtaaaagaaaagcaaatgaaaaccacactgagtgacagataaatgcagtaagttaatcttgattggatcctggactggaagagatgcaatattttgggtaaattaggggaaattttagtatagactaatatattcaggggtcagtgatctttttctgaaagagccagataataaatactttggattttgcagaccttatggtctttgatttatctactgacctgttacagcacagaagcagatgtagataatacccaagtaatgagtgtggctgtgtttcaattaaacttaataaaaactggcagtgggccatacttggtcattcatgcattagatgatattagtaaactgatgttaaatatcttgtgtgttcagagatagtgagattgtggttatataggagaaaacatctaaagtaggtaggggtaaaatattgtgattgatgtctccctccaaaaaaattgtacaagtatatgcaaaaaaataaaaagccaggcaaagtggtaggtgcttatagttccagctactccggaggctgaggcaggagcattacttgagcccagaggtttgctttaaaaaaaaaaaaaaaaaaaaaaatatatatatatatatatatatatatgtctacacacacatacatatgtgtgtggggaggggttttataagaattggttaagctgagaggaggaggagcaagatggcagaatagtacccttcaaccatcgtcctcctgcaggaacaccaaattgaacaactatccatgcaacaaaataccttcataagaaccagaaatcaggtgagtgatcctagtacctggttttaacagcatctcaaggaaagaggcatcgaagagggtaggaaagacactcttgcattgcctacaccaccccttccctatcccctggcagtgtgcggagatagaatctgtgtgcttgcaggaggaagagcaaaatgattgtgggactttgcattgaaactccagtgctgtcatatcacaatggaatacaacacagggcagaattctgccagcacccatggagggagcattcagactagccccagccagaggagaatcttccgccccagcggtaggaacctgagttgcagctagttccaccaccagttgagtaaagtggacttgggtcctgaataaatttgaaaggcagtcaggccacaggactgcattcttttggcacgtcctggcactgtgctggggtcagagcctgtggatttggggtgcacacaactcagacaccagctctggtagtgaagggattgccactcccacaacttgaagcagtggagcttggggaggtgctctttccatttggggaacggagaggaaagagtacagaatattgtgtcttgcaacttgagcactagctgagccacagtaaaataaagcaccagtcattcctgaagcctccaattctaggccctagaccctggatggtatttatagccccaccctgggccagaagggaacctactggccctgaagggaagggcccagtcttggaagaatttaccacctactgagtaaagagcccttggaccttgaataaatatcagcggtcgccaggcaggagttgccacatgccttgggcaagacccagtactatgctgtgttcagttgtgacccagtccagtgccagctgtggtagccatgggagtgcttgcaccacccctccctcaactccaggcagcccatcatggagagagagactatttgggggaaagtgaaggaagagaatgagagatcgcctaataatctaggaaattcctctccatcttacccaagcacaccaaggtgagacctccaggagcctgcaagggtcacagtcttactgggcttggggctccctgtagtgcagatacggctgcagtgaccaaagacttagattacaacactcaatttcctttgaatacctggaaagccttctcaagaaggacagataaaaacaagtccaaactgtgaagatagaataaatacctaactcttgattgcccagacgtcgatgaacacctgcaggcatcaagaacatccaggaaggctgggcaccttgggtcacgcctataatctcagcactttgggaggctgaggcaggcagatcacctgaggtcaggagttccagaccagcctggccaacatggtaaaaccctttctctactaaaaatacaaaaaaattagctgggcgtggtggcgggcacctgtaatcccagctattcaggaggctgaggcaggagaattgcttaaacttgagaggtggaggttgcagtgagccgagatcatgccattgcactcaagcctgggtgacaagaatgaaactgtctcaaaaaacaaacaaacaaaaaaaacatgcaggaaaacatgacttcaccaaactaaaggcaccaatgaccaatctcatagtgacagagatatgcaacctctcagacaattgaaaatagctgttttgaggaagcccagagaatttcaaaataacacagagaaggaatttagaatcctgtcagagaaatttaagaaagagattgacttttttttttttttttaaagacagagtttccctcttgttgcccaggctggagtgcaatggtgtgatctcagctcactgcaacctccatctcccaggttcaggcaattctcctgcctcagcctcctgagtaactgggattacaggcatgtgccactatgcctggctaattttgtatttttagtagagacagggtttcaccatgatggtcggactggtctcaaactcctgaccttgtgatctgcctgcctcagcctcccaaagtgctgggatttgagtgaccacacccagctgagattgacatatttttttaaaaaaataagcagaggctgggcacagcgactcacacctgtaatcccagcattttgggaggcctaggtgggtagatcacttgaggcaaggagtttgagacaaacctggccaacatggcaaacccccatctctactaaaaatacaaaaattagccgggcgtggtgacacaggtctgtaatcccaggtatgcagaacgctgaagcacaagaatcgcttgaacctgggagacagaaattgcagtgagccaagatcatgccattgcactccagcctgggcaacagagcgaactctgtctcaaaacaaacaaaccccaacaaaacacaaaaaacaaattctggagctgaaaaattcagttgacaaactagaaaatacatcagaatctctcaacagcaaaattgatcaagcagaagaaagaattagtaagcttaaggacagactgtatgtaaatacacagaggagaaaaaagaatgaagcaaacctacaagatctagaagtcacagggcaaatctgagagttattggtcttaaagaggaggtagagagagagagagagggtagaaacttcactcagatagtaacagaactttccaaacccagagaaaggtatcaatattcaggtacaagaaggtcctagaacaccaagaagatttaacacaaataagattacctcaaggcatttaatagtcaaactcccaaaggttgaggataaagaaagaatcctaaaagcagcaagagaaaaggaacaaataacatatgaaggagctccaatacatctggcagcagacatctcagtggaaactttacaggccaggagggagtggcatgtcaagtgctgaaggaaaaaaacgtttatcctagaatatcatacccagcgaaaatatacttcaaacatgaaggagaaatactttcccagacaaacaaaagctgtgagggattttgtcaatatcagacctgacctataagagatgctaaggggagctctttaatctgaaaggaaaggacatgagtgagcaataagaaatcatccaaaggtacaaaactcactggtatcagtaagtacacaagaacagaatggcttgacacactaattgccgtgtgtaagccatattttgagtaggaagactacaaagcctatcaaaaattataattacaattttttaagcgataatataaaaagataaatagaaacaatggccgggcacggtggctcacacctgtaatcccagcactttgggaggctgaggcaggtggatcacgaggtcagatcgagaccatcctggctaacacggtgaaactctgtctctactaaaaatacaaaaaaattagccgggcgcggtggcgggcgcctgtagtcccagctactcgggaggctgaggcaggagaatggcgtgaacctgggaggcggagcttgcagtgagccctgattgtgccactgcactccaagctgggcgacagaacgagactctgtcaaaaaaaaaaaaaagtagaaacaacaaaaagtcaaagagggggatggagtttggagttaaactgtagagttctgttttcgttttctcttgactttttttttttttggtaacgagttatcagtttgaaatagttgtttataagatgttgtttgcaagcctcatgaggcttttattttgaggtaaccatgtaacctcaaaacaaaaaatctacaacaggtatacaaaaaatgaaaagcaagaaataaaactatactaccagagaaaatcatttcaacgcaaagaaggaagggaggaagggaagaccataaaacaagtagaaagcagataacaaaatggcagtaggaagtccttacgtatcaataataacattgaatgtaaatggactaaagtctctaatcaaaagacacagattggctgaatggaaagaaaaataagacccaaccatatgctgcctacaagaaactcacttcacctataaagatatacacagactgaaagggctggaaaaaccagaactcctctttttccatacaaacagaagccaaaaaaagagagcagagtagctatacttaatgtcaggtaaaataggtattaagataaaaattattaaaaagagacaaggtcattatataatgataaaaaggtcagacaatataaaaattatgtatgtgtgtatctatctatctatctatctgtctccacacatacctaacactggagcacccagatatataaagcaaatattatctgagctaaagagagataccatcacaaagaaggcaagaaaacaaacaaaaacggaaaagagccagagagagagagagactcaacaatgcaataatagctagagacctcaacaccccactttcatcattggactcaaaatcaacaaagggccaggtgcagtggcttacgcctgtaatcctattagtttgggagactgaagtgggtggattacttgaggtcaggagttcaagactggcctggccaacttggtgaagccctgtctccactaaaaatacaaaaattagccaggggtggtggcaggcacctgtagtcctagctattcgggaggctcaggcagaagaatcgcttgaaccctagcagcggaggttttgttgagccaagattgcaccactgcactccagcctgggctacagagtgagactccatctcaaaacaaacaaatgaacaaagaaacgtgaccaaccaggggcggtggctcacgcctgtaatcccagcattttgggaggctgaggtgggctgatcacatgaggtcaggtgttcaagaccagcctgaccaacatggagaaaccccgtgtctactaaaaatacaaaattagctgggtgtggtggagcatgcctgcaataccagctacttgggaggctgaggcaggaaaatcacttgaacccaggaggcggaggttgcagtgagccgagattgtgccattccactgcagcctgggcaacaagagcaaaacttcatctcaaaaaaaaaaaagggagggatcaagattttttttttcttagtatacttttcttttccaatttcattgctttggcaccattatagaaagtcaactgatcatatatgtgtaggtctacttctggattttctgttctcttacaatgatgcctattttttatgttaacactacacagtattactgtgtcttcatagtgtgtctcaaaatcactgtgagtctggcagctttatcctttttccagattgttttggcaattctgagtcctttgcattttcatataaactttaaaattagtttgtcaaactctgttgtttagtaagcatgctggaatgattgggattgtgtttatacattagtttggggagaatggacatctaataatagtaagcctttcagtgtatgaacatggtatatatctttgcatttattttttctcagtattatctgtaatttttagtgtatacatcttacatatacattcttgttaaatgtatccttaagtatttcatgtttctgaattggctatgaacagaattttaaaaaatattatcttctagttgtttgtatatagaaatacagttgatttctgtattttgactttgtatcctctgaccttaccaaagtcatttattacttctaggagcttttttgtatattctgtgaaattttcatagacacttataagtagtgacagttttatttcattctttgcaatctgtatgccattttttccttgccttactgcactggctaagactggctgcagtgttgaatagaagtaatgagagaggacatctttccctagttctcagtcttggaaagcattcagtttttcactactgtgtatggtgtcagctgtaggctttcctattattcctattttcctgagagtttttaatcataagtaaatactgaatttcatcaaatgcttttcctgcatctaagcagatgaacctatggtttttcttctttattctgcgaatgggacccaaactgaaggagcagcacctttcctgagacatggcagtctcacatggtagctctgaaagtttcaatctgatcgtgacataacttcacttctgcttattacatccttttgattaaagcaaatcacatgacaggactacacttctctctttgggagggcagagaagtcacatggcaatgggcaagtctgtataatcttctcacagggagggcaacaaataattggggtcagtgatacaatctgtcatgcacattgttcttaattatgtgtacaggttaaatatcccttattcaaaatgcttgggactagaagtgttttgaactttggactctttcagattttgtaatatttgcatatatataatgagatattttgggggtagaaccaaagtctaaacacagaattcacttatgtttcatattcaccttagatgcatgccctaaaggtaatttacaatattcttagtaattttgtatatgcaacagtttatgtacattgacccatcagaaagtaaaaatgtcactacctcagccacccctgtggacagtctgtggcatcatgtcagcactcaaaaagttccagattttggaggatttcaggtttttgggttagagttactcagcctgtataaagctctatgtatgtctat

SEQ ID NO: 1650 - DNA, 88627 bp, Homo sapiens
gggagttgattaaattaggaaacattcatataaggcaatatttacttaagccattacagtaattttatagatctaggtagttattagtaatgatgacctgggataatttgtttttttggtttttatttttgagacagagtcttgctgtcttgtccaggctggagttacagtggtgcaatcttggctcactgcaacctccacctcccatattcaagcagttctcctgcctcagcctcccgagtagctggaactacaggcatgtgccaccacacccagctaattgttttttttttgtatttttagtagcgatggggttttgccatgttgcccagcctggtctcgagctcctgagcccaggcaatccacttgtctcagcatcccagagtgctaggattacaggcatcagccaccatgcccagcctaatttgtttttgtttgtttgtttgtttgtttatttttgggacggagtctcgctctgtcgcccaggctggagtgcagtggcgcaatctcggctcactgcaagctctgcctcccgggttcacgtcattgtcctgcctcagcctcccgagtagctgggactacaggcgcccaccaccacgcccggctaattttttgtattttttagtagagacagggtttcaccatgttagtcaggatgctctcaatctcctgacctcgtgaccggcccgccttagcctcccaaagtactgggattacaggcgtgagccaccatgcccggccttggtttttttttgttttgttttttgttttttaagttttaacaaatctcattttttttaatgatatgtatgacttgaaaaaaatttgagaaacctaaacaggatggtcaatggtgaggttgtggttatttttaattattaacattgttttattttttaaagcaatatgggctgggcacagtggctcacacctgcaatccagcactttgggaggccgaggcaggtggatcatttgaggtcaggagttcaagaccagcctgaccaatatgatgaaaccccacctctactaaaaatacaaagattagcaggtcatggtggtatgcatctgtaatcccagctactcgggaggctgaggcaggaaagtcacttgaacccaggaggcagaggttgcagtgagccaagattgcaccactgcactccagcctgggtgacagagcaagattccgtctcaacaaaaaaaaacaaaacaaaagcaatatgtattgcatttataaccgaagaaaaaccaaaggtgaatctgatttcagaaaagtaacttaaggaaatgtaacatctaaaaataagaggaaagtatcaaatctaaatttaaatgggataatgataaccccagtttagtatttatggtgattttctttaaagaagaaagaatcccttagactttatggagtgctctgtgaccgtgttgagctatcttaagtggatcaaagatgttcttctatttttaggccttgtacctaatagcaactaatggaaccccagaacttcagaatccagagaaactttccccaatatttcgggatttcttaaatcgatgtttggaaatggatgtggaaaaaaggggttcagccaaagaattattacaggtaaatttaaaaatgatttcatttgggggaatagttgacttttttggtaaccgacagaaagctttcctagggctaataagtagatttcactactcattgatcaccagcggtatggcagctgctgcaatttagggtttcatcctaccatgctgagcaaactaccgcaaggacagaaaaccaaacactgcatgttcccactcataggtgggaattgaacaatgagaacacctggacacaggaaggggaacatcacacaccggggcctgttgtggggtggggggagtggggagggatagcattaggagatatacctaatgtaaatgatgagttaacaggtgcagcacagcaacatggcacatgtgtacatatgtaacaaacctgcacgttgtgcgcatgtaccctagaacttaaagtattaaaaaaaaaagtgagggtttcatctgctgtgaataaaattctgacaaaaccgtaatgtgcagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcactcctcagacctgtttattgctgttgtgtgtatatttgtcaaactaaaatgattctgctttcattcaactctgaaagtaatgcgttgattatgttagtcttatgaaggtattaatatgtgtttagtttattaaattatgatcgacaagtagtctttggggcttaattgaacaaaattattttgtttctaacctgatgaatggcacttatacatttatttttccccttctttctggcagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaatggtgttgtgccatcattttgaatttattacaaagctccaaagtaggaaggtttctagaaatgtgtgggcagtaaacatgaagttttccttttttttttttttttttttttttttgagacaagtctcactctttcttccaggctggagtgcagtggcgccatctcagctcactgcaacctctgcctcccaggttcaagtgattctcctgcttcggcctcctgagtagttaggggaagttttccctttctaaatcaagttcagaataattttctttatcaatgtttctctatcagacccagggaaacagttctgatttgaacacacaccttgctggagtaataaaaacctgatcagaatttctgtgttaagtgaaccaagaaaccttttagagtgcaatacgtcgtaaggcatcacttcattatgtgaattaatttggaatcttaggtaccctaacatagggaacagccacaataatggtttactatcaaaaagcataaaataaggccaggcgtggtggctcacacctgtaatcctagcactgggaggctgagactggcggattgcctgagctcaggcaggagaccagcctgggcaacatgatgaaatcccatctctactaaaatacaaaaaaaaatcagccaggtgtactggcacatgtctgtagtcccagctacttgggaggctgaggcacaagaattgtttgaacccgggaggtgaaggttgcagtgagacaagatcatgccattgcactccagcctgggtgacagagcaagactcctgtctcaaaaagaaaaaaaaaaaaaaaaaaaaaaaaaaaaaaaaaaatatatatatatatatatatattctgggtgagaaggggaggcaatgactttgaaatgtatttgttacactatatggctgtttcgtcttgttctaacatttatatttctttgaactaatagcaaatgctcaaagcattgcctaagaaaacttttaaaagcctgtggttaatttcagaagctctatctctagggcttggcgggaggatggctcgagcctgggaggcagaggttgcagtgagccaagatggtgccgctgtactccagcctgggtgacagagcaaggcccctgtctcaaaaaaaaaagagttggtaattgcctatatctctataaagagaattttatagtctcaataatcctgattatagctgttttacccatacatcttagtttggggttagggaaaaagactaaaaatgctgcatttctgggaaacaatttgttcagaaaatgacagcatttatataaacttgtgagttacgtgaagagactgctgatcttcgccgggcgcggtggctcccgcctgtaatcccagcgctttgggaggccgaggcgggcggatcacgaggtcaggagatcgagaccatcctggctaacgtggtgaaaccccgtctctactgaaaatacaaaaaattagccgggcgtggtggcaggcgcctgtagtcccagctactcgggaggctgaggctggagaatggcgtgaacccaggaggcggaggttgcagtgagccgagatcgcgccattgccctccagcctgggcgacagagcgagactccgtctcaaaaaaaaaaaaaagagactcctgatcttgaaaggaatgacgcccgtggatacgtcatctctggatagttgttagaaggtgcccgttgcattccctcgttcatccgtcccagtttgctctggagcagatgcaaacgtctcaccctcgtagtgctgtaacaggccagatagagtgacagtgccagatagagtgacagtgccatacatttctgtttttcattcttagacctgtaggtatgtacagcacagcatcatcaacgcgttgccaaaaaactattttcctccaattcttaataaactacttcactttgacttctatatttaaaatagaagtatagggccaggcgcagtggctcacacctgtaatcccagcactttgggaggccgaggtgggtgtatctatcacctgagggcaggagttttaagaccagcctggccaacatggtgaaaccccgtctctacttaaaatagaaaatgagccgggcatggtggcgggcgcctgtaatcccagctactcaagaggctgaggcaggagaatcgcttgaacccgggaggcagagattgcagtgagccaaaatcacaccattgcactacagctttttgagactccgtctcaataaaatagaagtgtaccattttcaaaacctagttgatcacggccataaaattaagtaatatctaacagtacaatccaactgtgattgctttaatatattgtcagtaaaatctttaaggagtttcaggattgaaactagaagacatcttagtcacattcaatattccttacattttagtacactttacgatttgctgctagtatctttgttgagctgtttttcagtaaactaaaaatcttaatcatttgaggttttagtatagatactgtcactgttttgttcacactcttggtgctgtaggagtgtaaatgaccatctcatttgttcatctgttcatgctctattggagcatgccgtaagactgtggtgtcattgaaagtgacctttggccatggactgttggatatgtggatcagctactttcatataacttgcattgtcagcaaatacttttccacttcccttcagccctgcgtattttaccacggataaacggtgttccattatgcgcctgctctgtcccatttccgtagtgtcttttttttatgacaaagcacagctggtcaaggtgttatcatgggtctgagtgcacgagtgtttgttgctgcacgttccccatccagtcactaagcaagacacagaactgtatgaaagcttatttttacttagtttcatcttagagtcacatttgaacttgtgagtttcttttaaatgaaactgtgtttaattttgagatttgctgctagggggaggactccttacgctttttgaagttagtaacagccctctctagtagaatgtgcacaaaaacggttaatgtgaattggtgggcttgtttctgtgctttgttttgagtgataatacaagggcctacatcatagggggttttcagggttaaattcattcatttcaaataaaatatttagaatgatgtctagcacaaagtcaacatttgataaatgtagtctcctctcattgcttttttcccctctgatattgcgggagcagatgcagaagtaacaggatgctgcacagagctatttgcacttttctcccatctctcgtatttaaaaaatggatgcattatggaaattatgctgcaaatattacacagcttttttttttttttttctaacacaggatctcactctgtcgcccaggctggagtgcagtggcacaatctcggctctctgcaatctctgcctcctggattcaagcgattctcctgcctcagcctctgagtagttgggactacaggcacgtgccattaccgcccagctaattttttgtattttaagtagaggcggggtttcaccatgttggccaggctggtgttgaactcttgacctcaagtgatccacccgcctcagcctcccaaagtactgggattacaggcgtgagccaccacgtctggctgttccacagctttacacaaagaaggcccccagtacatccctatttggtcacacagtgtgaaattgtgtattttacagtattgcatagttggcaatatgagactgtgcattgtagtttggataatcacttccctgaagggatattgcagataaaaaagtttaatttgagaattggttcttgaagtttttgtttgttgttttttgagacagagtctcactctgtcacccaggctggaacgcagtggcatgatctctgctcactgcaacctccgcctcccggattcaaacaattctcctacctcggcctcccaggtagctgagactacaggagtgagccaccacacccagctaatttctgtattttaagtagaagcaaggtttcaccttgttggccaggctggtcttgaactcctgacctcaagtgatccaccacctcagcctcccaaaatgctgggattacaggcgtgagccaccacacccagctgttacagagctttacacaaagaaggcccccagtacatccctatttggccacacattgtgaaattgtgtattttacagtattgcatagctggcaatatgagactgtgcattgtagtttggataatcactttcctgaagagagattgcaaagaaaaaaatttaattcaagaattggtttttgaagtttttgtttgtttgttgttttaaatagagacaaggtctcactatgttgcccaggctggtctcaaactcctgaactcaagtgatcctcccgcctcggcctcccaaagtgctaggattacaggtatgagcgaccacacccagccaagaattgttttatgtatctattagaaataagtttgtaaaccacaggttccaaagtgttagtacctttaatgtaacaggaagttcagtgtttgtcagtctggggttgtcctgggacaaccagggagtccagcaaccccaccagcacttgggactccacgttgtcactctatcattcttagcatgtaggcctgtatccttaatgcctgttgcaacatagatactagatggctggtgcacctccaacctcttgtccgggtgtcaagcaggagaaagagagatggcaaaaggcaacgtggaaagcacaagggagtagtgcttatatcgagagaacacaaattttcccagaaaccctcaacttctgtcccactggccagaactgtcatttggcacctcatagctgcaagagagtctagggaagagtgtttctccagataaaatgagactcgttagtgaagaaggagggatggaaatagtatataattgtgactactatagtttgagtgtgaaaattgctctattggaatttttttgtagctcttcccctactatttctacagagcactgccccgtctgttgactcctttgatactacatggttgatggggtgctcacttttagatatgagaaaaggggctagagcattaatctcttcagtgttatccaggtagaatttcagctcttctgggttaaggaactggaaacttttcaactctctaggcctcatctcagctagagagctagttttgaagaaacgtaattgcttatgaagtcataaatgcagtttaaatgtaattggcagtgttgcaagtttagtgatccatcgtgggaggagaccacaagtatctgctacaaattcctgattgagcaattgattgatttagtttagcaggagcctaggtgaccctgagcaaatagtccttcatgggtgttcctggcccctaagtgtcctctagggggtgctgctcccactgtcatgctcctcaaagatggagcctgccagaggtgaaagcccaattcctgccattgccctgctatcctcgggtttatgtcccattctggaagaactcaaatgtaacattattcaatgttacaagcagtctcactgttcagaaacatggagttcttttggttcttgagtcaaacttggtatcagcaaagctacattctcatagggagagaaaacaagtctgggtgtctccccaacttcctagtgctccagagagcctggctccctgtaataattcttattcttaaaaaaaaagtaactacataatagagaaatacattctgatttataaaatttcagccattcagacaaaagaaagcctcttcaatcccagtccaagtccccgttccaaaggaaatctcttactagtttccatcttttcagacctttctctttgcattatacctagatactggtcagttttgtagaccaagcagttcttgaaggctgcaatcaaagacaatttatgtttgtttccctctcttctaacccattttacaggggtagttcttccccattccctggatgaaatttagagcaaacacccaggcagttttaccaatgagttctaagaatattcaaagaaaaaattccaatcctgcacaaagtatttgaggatatagaaaacattccccaaattctattataaggatggagtagccatgataccaaaataattgaagaagaaaattataggataggccaggcgcagtggctcacaactataatcccagcactttgggaggctgaggcaggtggatcacctgaggtcaggagtttaagaccagcctggccaacatggtgaaactccctctctttagctgggcatggtggcatgcacctataatcccagctactcaggaggctgagacaggagaatcactttaacccaggaggtagaggttgcagtgagccgagatcgtgccgttgcactccagcctgggcaacaagagtaaaactccgtctcaaaaaaaaaaaaaaaaagtataggataatctcataaatacaaatgtgcaattattaaatatattactagcaaaccgaatctagcaatgtatgaaagaggtagtgcatcctaaacaagtaggcttatgcatgtaaaaatcaagataatttacagtattagtagattatctgggcatctcaacagattaaagagagtggctgagcccagtggttcacacctgtaatcccagcactctgagaggacaacacaggagaatcacttgaggccaggctcaagaccagcatgggcaacatagtgagaccctgtctctaaaaaacctaataaaaaaacattagccaggtatggtagcacacctatagtcctggctactctggaggctgagctaggagaatggcttgagcccaggagttcaaggttgcagtgacctgtgattgcaccattgcactccagcccacatgacagagtgacactgtctcttaaaaaaaaaaaaaaaaaagcattggctgggcacggtggctcacgcctgtaatcccagcactttaggaggccgaggtgggtggatcacctgaggtaaggagttcgagaccagcctgaccaacatggtgaaaccctgtatctactaaaaatacaaaaattagccgggcatggtggcatgtacctgtaatcccagctactcgggaggctgaagcagcagaatcacttgaacctgggaggcagaggttgcagtgagctgagacctctccattgcactccagcttcggcaaaaagagcaaaactccatctcaaaaaaaaaaaaagcatttagtaaaattcagtatcaattcatgattaaaaatatatattttagcaaattaggagtgaactttttttttccgagatagagtcttgctctgttgcccagactgcagtgcagtggcatgatctcagctcactgcaacctccgcctcccaggttcaagcaattctcctccctcagcctcccgagtagctgggattacaggtgtgagccaccacacctggctaatttttgtattcttagtagagacggggtttcaccatgttggccaggctggtcttgaactcctgacctcaggtgatccacgtgcctcggcctccgaaagttctgggattacagtgaagccactgtgccagccaggagtgaactgaatcacttgaacccgggaggctgaggttgtggtgagccgagatcacaccattgcactccagcctgggcaacaagagcgaaactccatctcaaaaaaaaaaaaaagaatttgaaagcaatggctgggcacaatgactcacggctataatcccagcactttgggaggccgaggcaggtggatcacctgaggtcaggagtttgagatcagcctggccaacatggtgaaacctggtctctactaaaaatacaaaattacccgggcgtggtggtgggcacctgtaatcctggaggctgaggcaggagaatcacttgaacctgggaggtggaggttttagtgagccgagatcacgccactgcactccagactgggcaacagagtgagacttggtctcgaaaaaaaaaaaaaaaaaaggaattggaaagcaagataaaatctcattattttcagataaggttgatatgataaactattaaaattaagaaatttagcaagtttgctgtatgcaaaatcagtgtgcaagagtctattatattgctaagcactagcaacaaatagaacacataatcttaaaaatctaccatttataacagatcaaaaatacaaagtacctagaaatggtcactcctgtaatcccagcactttggatcacctgaggtcaggagttccagaccagcctggccaacatggtgaaaccccatctctacaaaaatacaaaaattagttgggcatggtggcgtgcgcctgtaatcccagctactcaggaggctgaggcaggagaattgcttgaacccaggaggcagaggttgcagtgagccgagatcgcaccattgcactccagcctggggtgatggagtgagactctgtctcaaaaaataaataaataaacaaaaagggaggattttactgaaagattttaaatgttggattggaaactattttatggatagttgaaattgcacttcaaaagagaaacaatttaattcaatttaagccagataaatgaaacattggttcaaagtcagaaatacatagtcctctaaattttagtataaagagacactttacagaagccataaagtagcctgtagaggccagcaccggggcttatgcctgtaatcccagcactgtgggaggctgaggtgggtggatcacctgaggtcaggagttcaagaccagcctgggcaacatggtgaaaccctgtttctactaaaaatacaaaattagccgggtgtggtggcgcactcctatagtcccagctacttgggaggcttaggcaggagaatcgcttgaacccaggaggtggaagttgcagtgagctgagatcatgccattgcactccagcctgggcacaaagagtgaaactccatctcaaaataataataataataataataataataataataataatattcaaaaaggagaatagttgggaagcctataaatttcagcctatcctaattcagggatcctgcttctaggaggaagaaaaaaaggcatccaatagagatgaatgaacgttgtataccccctttgcctccttttcaggataatttagtgcaaactttaatactcgccattcagatgctcttcagtcataactcctaaacatgctgagggcctgttgtgtgtctgaattagtggatagggaaatgaggcacaaaaggcaattttgaagactggcctctttcagaattgcagagtttggtggactttatttttttctttttttggggggtggggggcgcaatctcactctgtcacccaggctggagtgcagtggtgtaatcggctcactgcaagctccgcctcccaggttcaagcgattctcctgcctcagcctccccagtagctggactacaggcgcccaccaccatgcctggctaatttttgtattttcagtagagacgtttcagcatattggccaggctggtcttggactcctgaccttgtgatccgtccgccacagcctcccaaagtgctgggattacaggtgtgagcccctgcacctggcctttggtagactttatattgaggagcttttgtggctgagtaaactctggacttttggaaggagaagaggtagaaaggtgttcatggaaagggacccaatcccccaggagagggttcttggacctcatgcaagaaataattccaggggagtccacggagtaaactgaaagcaagtttattaagaaagtaaaggaatagggccgggcggggtggctcacacctgtaatcccagcactttgggaggccgaggcaggcggatcaccaggtcaagagatcgagaccatcctgccaacatggtgaaaccccatctttactaaaaatacaaaaattagctgggagtgttggcatgcgcctgtaatcccagctactcgggaggctgaggtaggagaatcacttaaacccgggagcagaggttgcagggagccgagactgtgccattgagctcctcctgcctgggccacaagagcaaaactccgtctcaaaaaaaaaggaaaagaaaggaatagagcacgtctgctccataggcagcgcggcagcttgggctgcttgactgaatatacttacagttatgctaaacaaggggtggattgttcatgagttttccaggaagggggtgagcaattcccggaactgaggattcctcccctttttagaccatacagtgtaatttcctgacgttgccatgtcatttgtaaactgtcatggtgctggcgggagtgtccttcagcagctaatgcattataattagcgtctaatgaacagtgaggaccaccagaggtcacctcattgccgtcttggttttggtgggttttggctggcttggtaacacatcttgttttatcagcagggtctttatgacctgtatcttgtgctgacctccaggcctcagccttattttaaccagtccttattcaagatggagtcactccggttcaaacacctctgacaaagggataaagaaaaacgtggtctgcagattgttgcaaatgaacctaagccaggtttgatcatgcctcatttttgtttggttgtttttttcctttttttttttttttttgagacagggtttcacactgtcactcgggctggagtgcagtggtgcgatctcagctcactgtaaactccacctcccaggctcaagtgatcctaacacctcagcctctcaagtagggactacagccaccacacccggctaatttttgtgtttttttgtagacgggtttcaccatgtgacccaggctggtcttgaacccctagcctcaagtgatccaccgcttcaaccttctaaagtgcttggattacaggtgtgagccacctcacccggacatgcttaggttgtttctgtaaagttatagctacctatggagtttgaggtggtgagggttaactaacttctgacaacccccctgccagattataatgaaagcaagtcgcagaccaaatcttgtcacacacctgaaagctcatttaagcaaacatttgtcagcaaaagtgtttgttcagcctatcctgtagctcactataatccatgctctctgtcccaaatgctctgtccacaactttgcatgaaaagttcacttgaggcagagagggaaacgtgccaggggccaggattctgttacccttaaagatggcatcatgtaaccagacatcctcttaactagtggctggtcacaggattatgtaacgatggagccctgagggccattcctaaggggtcgcgttgctgacctcactagattcttacaccttgtttatgcaaaggcagcaggagtctctcaaataactttagccaatggaaggatcccgaacacctttcatttcactgatgagagcccactgatgacctcattaccaattaacaagcaactcagttcatcaggaaacagccatttctttttccatttatttatttatttatcgagacagtgtctagctctgctgcctaggctggagggcagtggtgtgatcatggctcactatagctttgacctcctgggctcaagcaatccttccagttcagcttcctgagtaactgggagcagagatgctcgccactacagctggctactttttttattttttgtacggatggggtctcactatgttgcccaggcttgtgactgcacaatgggttccccttgcccgttgcctaggcagaactgatacctcacgacaggggaactgcagtacagaaagagtaattcacgcagagccggctgtacaggagatcgcggttttattattattcaaatcagtctctccaggcattgggggatcagtgtttttaaggataatttggtgggtgggggaaggccagtgagagagtgttgattggttgggccggagaggaaatcatgggaaattgaagctgtcttcttgcgctgagtcagttcctgggtcggggccacaagatcagatgagccagtttatccatctgggtggtgccagctgatccatcaagtgtggagtctgcaaagtatctcaagcgctgatcttaggagcagtgtagggagggtcagaatcttgtagcctccagctgcatggctcctaaaccatcatttctaatcttgtgactaatgttagtctagtcccccggcaagaaggaggtctgctttgggaaagggctgttaccgtctttgttttaaactataaattaagtttccccccaagttagttcagcctacgcccaggaatgaacaagggcagcttggaggttagacgcaagatggagtcggttaggtcggatctctttcactgactcagttacaattttgcaatagcggtttcaggctgatctcaaactcctaggctcaagtgatcctcccgcctcggcctcccaaagtgttgggattacaggtgtgaacccccacacccagccaaaaaatctatttctgatcatcactcagcttgttaactgagcctcaggcgttgattgagatgtagataatagaaatgcttgcagtactgcactccagtctggaacaacagagcaagaccctatctcttaaaaaaaaaaaaaaagtgccagtagtagctgcctctagtgtgtaagtaacctttctgactagacactggctacccttatgtgtgaattttctttctttcttttttttttttgagacggagttttgctcttgttgcccaggctggagtgcaatggtgtgatcttggctcaccacaacctctgcttcccaggttcaggcaattctcctgcctcagcctcctcaaggctcacttgaacccgagtagctgggattacaggcatgccggctaattttgtacttttagtagagatggggtttctccatgttggtcaggctggtctcaaactcctgacctcagatgatccacctgcctcggcctcccaaagtgctggaattccaggtgtgagccaccgtgcccggccttcttcttctttttttttttttaagacagagtctcgctctgttgcccaggctggagtgcagtgacacaatctcagctcactgcaacctctgcctcccaggttcaagcaatttccagcgaatttttgtatttttggtagagacagggtttcactatgttggccaggctggtctcaaactcctgacctcaagtgacccagccaccttggcctcccaaagtgttaggattagaggcgcgagccactgcgcccggcctgaattttctaataaaacaatgcacgccatctttgctaaaatcttttaaagtaaattgcaggcatcataatagaagttggttcttaatatttgtagtttaactgcttattagcagtaatttgtagttgcttgtaattttactaaggtaggaatttaattttgtgacctagaagattgatgggtaggaaggaggatcacttggcttagtaaatgaagttagccagtcactcttcatccaaactttcttcttggcatttaagcactaattcccattaatgttcaacttaaattttcagttgaactttagtgattttttgggggggaacattatgttatttagggctatttgggaatttatgatggtatcaggatgtcacaggtttattgtgccataaaattttgcctatggcagactgtgcctccagtcttagtcccagaagttaagtcaggtgtctttacctctaagattccagtttaaaaaagaaagaaaaaataaataagatacaatacaggccgggcgcagtggctcacacctgtaataccagcactttgggaggccgaggcaggatgatcacaaggtcaggagatcgagaccatcctgactaacacggtgaaaccctgtctctactaaaaatacaaaaatattagttgggcgtggtggcgggcgcctgtagtcccagctactcaggaggctgaggcaggagaatggtgtgaacctgggaagcagagcttgcagtaagctgagatcacaccgctgcactccagcctgggcaacagggcgagactccgtctcaaaaaaaaaaaaagatacaatacagttccaatttagagctgggcattgtggttcacacctgtaatcccagctacttgggaggccgaggcaggaagggaggattgcttacacccaagagttagagaccaatgtaagcaacaaattgagatgcctgtctctaacgacaacaaaaaaatccagttcagtatggctaaattatacagtccatgtcctgtgatgcttacatgagttcttggggtcacgacattagccccattaaatgttccacaaggccatgagcattttttcgaagacaaaatattttaaggactagagtctttaaaggatttttggctctgtcagtctcacgctgtcacccaggctggactgcaggggcacaatctcggctcactgcaacctccgccttccgggttcaagtgattctcctgcctcagcctcccgagtagctgggattacaggcacctgccaccatgcccagctaactgttttttagtagagacggggtttcaccacattgaccaggttggtgtggaactcctgacctcaagttatcctcctacctcggcctcccaaagcgctgggattacagatgtgagccacggcgtctggactgtttgtaaactttttgccaacattttggatgaacgctgcttattcctgtgaatcaaggggtgatctcctgcagcctggaagaaacaaaaagggatgggtagtaaaaatctggatcaatatactagttccggacaattatcctgcaaattctgccaggtaatgaaagtgagtagggtctccataacctggaggtttctttgttttggaaaataaaaccaagtaacttcataacccccaggggaaaatttttatatcttggcaagtaaaattttagatggaaataatctactatgccacccttgcaggaattgctattctcactctactatttgtagtagagctatataacagtagcactttctaattgaattttttttttgagacgttgtcttgctctgttgcccaggctggagtgcagtggcacaatcttggctcactgcaacctctgtctcccaggttcaagtgattctcctgcctcagcctcctgagtagctgggatcacaggcacctgccaccacgcctggctaatttttgtatttttagtagagacgaggttttaccatgttggccaggctggtctcaaactcctgacctcaagtgatctgcccaccttggcctcccaaagtgctgggattacaggtgtgagccaccatgcccagccatgttttgctcaattattatacctatagcagggataatagttaccaacaaaaaggaagcatgaaaattttactatcactgagtctgctagaacttcttattgggtttggtaatatgtcacaccctggctatgcaaagaaggttataaaagaaagagattttatgtaagaaaggaccttgtatggtaaatactcgtcctaaaaagaatagttggttgtttttgttttgttttgttttttgagacagagtcttgctatgttgcccaggcttaagtgcactggcacaatctcagctcactgcaacctccacctcccaggttcaggcgattctgctgcctcagcctcccaagtagctgggattacaggcgtgtgccaccatgcccagctaatttttttttttttttttttttagtagaaatagggtttcaccatattggccaggctggtcttgaactcctgatctcaagtaatacacccgcctcagcctcccaaagtgctaggattataggtgtgagccactacacctggcctcgttgtttaaaaaaaaggatgttcaagacaagtcggaaagtttaagcatgtcttagatggtctgtggaagtcatgaagggattcataatttaggaattatgcaggaaagatttagccaaagttaacactaaagttaccctagccacccaaatccagtgccacttatcctaaaaggaatgttacttttattttgttatttttactttttggccaggcacagtggctcacgcctgtaaccccaacactttgggaggccaaggtgggcagatcacttgaggtcaggattttgagaccatcctggccagcatggtgaaaccccatctctactaaaaatttaaaaattacctgggcatggtggcatgtgcccataatcccagctacttgggaggctgaggcaggagaattgcttgaacctgggaggtggaggttgcagtgagctgagattgcaccactacacaccagcccaggcaacagagcaaaactccatctcaaaaaaaaaaaaaaaaaagaaaaagaaaaaggaatgttgcttttatattaacatttcagcaacatctggtggaggcaagccagtgttagaacccatcagagtggctgacagcagtcaaactccaaacgctgcttcagacagaaccacgcatggacacgcctttcttccgaggacccttagattggccccaggaggagccctagctgctgttccccacgcagtgccccttttcagcaagaagcagccggaaagagtctttatccaacacccgctaacaatagttagggttacaccactccagagcgggggaatgatacaggagttaagaagaaattacttaggcagatagtgagggtatggaagtcttcagtaaggttttccttttagtgaaaaacagccccaaatcattttcctttctaacaaagaacagcctgtaaaattgagctgcagacatacatgccagcagttgtgccaatcatgttcgagatggcggctccctcttcccttctctgccagccacgtgtacagtaaggagcagacaagatggcactggccaaggggacagttcgcttgcataatgagattagggtggggcggccagccttccccgcacattgtgtaaatatcatacctaattgaaccaatctgtgagccccatgtaaatcagacaccccctcctcaagccagactataaaatccagcacatctgctgctggccagacttttcctctcgttaagtcccctctctctcactagagagagagctgttttattttctctttcttttgcctattaaacctctgctcattcacttaaggtgcttagcacagtgtctgtaaatagaaatccctcaaaacatattcgttattatttttaactttattttaagataatgttatttatttatttatttattttattttattttatttttttttgagtttcactcttgtcacccaggctggagtgcaatggcgtgatctcggctcactgcaacctccacctcctgggttcaagcgattctcctgcctcagcctcacgagtagctgggactacaggtgcccaccaccacccagctaatttttgtatttttagtagagatggggtttcaccatgttggccaggctggtgtcgaactcctgacctcaggggatcctcccgcctctgcctcccaaaatgcagagattacaggcgtgagctaacatgcccggtcaagagaagagttaactcttaaaaagactgttatcatgtcagataagaacagcaactttgtagctttctgaaccctctcaacttgccatgcagaataccacagccttaccagatggacatggcagatgaaggagttcaaaacagtggagcagctagaaacttaaaggatcaattctagaaatgagaaagtcacagttgggttggattcaaaatctgagtataaactctgcctaaattcctggctggctggccatactacaaaatgtacacaggagctccagggacccctacaaaatggcaaggaggaactgagtgggggccaggggtgggggcacccgggatcctacctcaaagacagaagtgatcctggtgagatttatgagttttatactgagtctgttcctcaacccacacacaattcaggtggcaaaaagtgaaagcattattggcttgaagggtcctgagacagaacttggggctcataagacaacatgaaatgtagagggtgtgccccatgcacaatctgttacccctcagctcgaaatctattattctttgccctgtaaggcataagaagaggtaggttcgcttcctggttcctgtgtactttcttcccctgtgatatgactcccagaagcactcaggaggatcagtggtgcttattctctctctctcttttttttttgacatggagtctcgctctgtcgcccaggctggagtgcggtggcgtgatctcagcttactggaacctccacctcccaggttcaagtgattctcctgcctcagcctcctgagtagctgggattacagtcacgtgccaccacgcctgcctaatttttttgtatttttagtggaaacaaggtttcaccgtgttagccaggatggtatcgaactcctgacctcgtgatccatctgcctcagcctcccaaagtgctgggattacaggcgtgagccactgcacctagcctttttttttttttcgacagagttttgctctgtcacccaggctggattgcagtggcacaatcttggctgactgcagcctccgccttccaggttcaagcaattctcctgcctcagtctcccaagtagctgagattacaggcgtctgccaccacacctagctaattttggtatttttagtagagacgggtttttgccatgttggccaggctggtctcgaactcctgacctcaggtgatccacccgcctcagcctcccaaagtgttgggattacaggcgtgagccagtgttgggattacaggcatgagccaccacacccagccctagacagggtaattatgtaagaaaaagaaataaaaaatatccatattgaagagaaagaaataaaactttgtcaattaacagacggcatgaccttgtatgaagaaaatcatggctgggcacagtggctcatgcttgtaaatcccagcactttgggaggctgaggtgggagaatcatttgaacccaggagttcaagaccagcctgggcaacatagggagaccccatctctactgaatgaatgaaagaatgaatgaaggagcaagccaggtgtagtggtgcacgtctgtagtccccgctactcagaaggctgaggtgggaggatctcttaagacccggaagttgaggctgcagtaagccacaatccacagtcccacgctgcactccagcctgggtgacagagcaggactctacctaaaaatatatatatatataagtaaagaaaatcctaaggaatccacgcacatacaaaaatattacaactaataaatgatttcagcgaggtttgaggacacaagatcaataaacaaaaagctacaataatcaagagtgtggtactaacataaaaatagacatataggccaggtgcgatggctcacgcttgtaatcccagcactttgggaggccgaggtgggcagatcacctgaggtcaggagtttgagaccagtctggccaacatggcgaaaatccgtctctactaaaaatataaaaattagccgggagtggtggcgggtgcctgtgatcccagctacgcaggaggctgaggcaggagaatcgcttgaacctgggaggcggaggttgcagtgagtggagattgtgccattgcgctccagcctgggcaacagagcaagactctgtctcaaaaaaaaaaaaaaaaaaagaaagaaagaaacaaaagtgttttcaacaaatggtgctgggacaaccgaatattcatatgcaaaagaatgaacttggacccttccttataccatctacaaacattccaaatgcatcacaggtgtacttgtaagagacaaaattagaaaacacttagaataaatcataggagtaaaccttcatgacctccagtgaggcaatcattacttagacatgagaccgaaagcacaagggacaaaagaaaaaaatagataaattggactggacaaaatgtaaaagtcttatgctgcagataatatcattaagaaagtgaggtgtggggcgcggtggctcacgcctgtaatcccagcactttgggaggccgaggcgggcggatcacttgaggtcaggagtttgagacagcctggccaacatggtgaaacaccatctctactaaaatacaaaaattagccaggcatggtggcacacacctataatcccagctacttgggaggctgaagcacgagaattgcttgaacccgggaggtggaggttgcagtgagccgagatcatgccactcactccagcctgggtggtagagtgagactccatctcaaaataaataaatacataaataaaaataaaaaaacacagaaagggaaaaaatatttgcaactcatacatatgataaagtgtttgtatccagcatcgagaccatcctggctaacacggtgaaaccccgtctctactaaaaatgcaaaaaattagccgggcgaggtggcaggcgcctgtagtcccagctactcgggaggctaaggcaggagaatggcaggaaccccggggggtgtagcctgcagtgagccgagatcgcgccactgcactccagcctgggcgacagcgagactccgtctcaaaaaaaaaaaaaagtatttgtatccagaatatataccaatatgagttgatgtattgatatataccaatattgaccaatatgtatctagaatatatatcagttagttttttaaaagttggcttcagaattgtttataacaatgttgaatactaaatgattatgttaatgcctttataatatttaatattttatataaataaaataaaatgtagtgtcattctagaattctgtacccaggaaaatcattgttcacatacaaaggcaggcaggccacaaacattttccaaatatgtaagcatggagagaaggttgttctcatgatactttctctaaaagttttcaaagagtagcattttccaatagaactttctgcaatgatggaaatatctgtatcttcaccctccattatggtgaaatcttcaaccccacgtagttagctattaagcatctaaaatgtcactagtgcaactggagaactgaattttattaattttatcaacttgttaattgattaataagttaaattaattttattaagtttatttttattttactttatttgagacagggtctcgttctgtcacccacgctggagtgccatggcctcaacttcccaggctcaagcaagccttccacttcagcctccctagtagctgggacttacaggtgtgtgcctggctaatttttgtattttttgtagagacaaagtttcatcatgttgcccacagtggtctcgaactcctgggctcaagccatccgcccacccccaccttccaaagtgttgcgattacaggcgtcagccatcgccttatttattttattttatttttttttttttgagagggagtctcgctctgtcgcccaggctggagtgcagtggcatgatcttggctcattgcaagctccgcctcccgggttcacgccattctcctgcctcagcctcccgagtagctgggactacaggtgcccgccaacacgcccggctaattttttgtgtttttttcagtagagatggggtttcaccttgttagccagatggtcttgatctcctgacctcgtgatccgcccgcctgggccttccaaagtgctgggattacaggcgtgagccagcgcgtccagccaatcgccttatttttaagtttaaatagctatgcatggatatcttttttatagtgtagagtatttcacactgaagagaaggtaaaatagttccttccttccttccttccttccttcctttctttcttctttatctctttctttctttctctttctttctttctttttaaatttgagacagggttttgttctgtcacccaggccggagtgtagtggcacagtcctagctcacttcgtctccaactcctagtctcaggcgatcctcctgcatcagcttcccagatagctaggactacaggtacacccaaccacatccagctaattttttttttttcccagacggagtcttgctctctcacccaggctggagtgtaatggcgtgatcacggctcactgcaacctccgccttccaggttcaagtgattctcccgcctcagcctcctgagtcgctgagattacaggcgcctgccaccacgcccagctaattttttgtattttcagtagagactgggtttcaccatgttggccaggctggtctcgaactcctgaattcatgattcgcccgccttagcctcccaaagttctgggattacaggcgtgagccattgcgcctggtctaatttttaaaatatgttttagatttgggggattgggagggtctctctatgtttcctgggctggtctccaactcctggcctcaagcaatccccctgcttaggcctcataaaatgcttggattgaaggcatgagccactgtgcccagcccaaaacagcactttttttttttttgagacggagtctcgctctgtcgcccaggtgggagtgcagtggtgcaatctcggctcactgcaatctctgactcctggattcaagtgattctcccacctcagtctcctgagtagctgggaaaataggcgtacgccaccacgcccagctaatttttgtatttttggtagagatgtgatttcaaccatgttggccaggttggtcttgaactcctgacctcaagtgatctggccaccttggcctcccaaagtgctaggattacaggcatgagccaccacaccagcttacccagcattctctacagtcacaccccctatgggggagatgaaagggaaaaaagacaaaaaaaaaattataggagtccgggtgcagtggctcacacctgtaatcccagcactctgagaggccgaggcaggtagatcacttgaggtcaggggttggagatcagcctggccaacctggtgaaaccctgtatctactaaaaatacaaaaattagctgggcatggcggtatgtgcctgtaattccagctagtcgggaggctgaggcaggagaatcgcttgaacccaggaggcggaggttgcagtgagctgaggtcacaccactgcactccagcctgggccacagagactcaaaaaaaaattatagggaaaaaaagaaaaaattctaccagcattaaaataattataaaatgtatatttttgagacagggtcttactctgttgcccaggttacaatgctatgatgtgatgatcatggctcactgcagcctaaacctccccaggctcaggtgattctcacctcagcctcctgggtagcttagcctcccgggcagcctcccaggtagctgggactacaggcatgcatcaccatgcctggctaatttttgtatgtttgtagagacagggttttgccatgttgctcaggccagtcttgaactcctgagctcaagtgattcacccacctcaacctcccaaagtgctggaattacaggcatgatccaccatgcctggcctccatacatccatattaaccttgaacgtaaatagtccgaatgccccacttaaaaggcacagggtgtcaagttggattaaaaaaaacactacctatccatctactgtcttcaagagacccatctcacatgtagtgacacccatatgctcagagtaaagcattggagagagatctagccacaaacagaacacaagaaagagcagggtcactattcttaatcagataaagcagactttaaaccaacaacaataaaaatggacaaagaaaggcattatgcagtgataaagaattcaattcaataagaagacaaatatcctaaatatatttatacccaatattggatcacccagatttatgagtccttctagacctatgaaaagactttgaaagccacacaataatagtagggtacttcaacacctgactgacactgctagaccgatcattgaggcagaaaactgacaaaaataggctgggcacagtggctcatgcctgtaatcccagcactttgggaggctgaggtgggcagatcacttgaggccaggagttcgagaccagtctggccaacatggtgaaaccctatctctgttttgtaaaatacaaaaattaggtgggcatggtggtgcacgcctgtgttcccagctactcaggaggctgaggcaggagaatcgcttgagctgggaggtagaggttgcagtgagctaagattgcgctactgcactccagcctggatgaaagagcgagactctgtctcagacaaaagaaaaagaaaaaggaaggaaggaaagaaaagaaagaggaaggaaggaaggaagggagaaagaagaaagaaagctgacaaaaattctggacttaaattcaacacttgaccaattggacctaatagacatctacagaatactccacccatcaaccacaggaatatacatttttctcatctgcacatagaacacattccaccacatgcctggccataaagcaagtttcgataaatttaaaaaaacctaaatcatagcaaccatattctcagacctcggtagaataaaaatggaaatcaataccaagaagatctctttaaaccacacagttacatggaaattaaacaacttgctcctaaaagacttttgggtaaatagtgcaattaaggcagaagtaaaaaaatctttgaaataaatgaaaacagagacataacatacggaaatctctgggatacagcaaaagcagtgttaagagaaaagtttatggtgctaaacacctacctcaaaaagttagaaagatctcaaattaatgaggtaacatcccacctagaggaactgcaattattggggaacctgccctgatagtcacgtaagttcttttctattttccctaaacatccgctggtttgagaaataaagggacagagtacaaagagagaaattttaaagccgggcatctgggggagacatcacatgtcggtaggttccacgatgccccacaagctgcaaaaccagcaagtttttattagggagtttcaaaaggggagggagtgtgcgaataggtgtgggtcacagatcacgtctttcatgaggtaatagaatatcacaaggcaaatggaggcagggcgagatcacatgaccacaggactggggtgaaattaaaattgctaatgaagtttcgggcaccattgtcattgataacatcttatcaggagacagggttttgagatcaaccggtctgaccaaatttattaggggggaatttcctcttcctaataagcctgggagtgctatgggagactggggtttatttcatccctacagtctcgaccacagaagatggccacacccaagggggccatttatagacccaccctcaggggtgcattctctttctcagggatgttccttgctgagaaaaagaattcagcaatatttctcccatttgcttttgaaagaagagaaatatggctcttttccgcccgtctcaccggtggtcagagtttaaggttatcgctgttattccctgaacaattgctgttatcctgttcttttttcaaggtgcccagatttcatattgttcaaacacacatgttctacaatttgtgcagttaacgcaattatcacagggtcctgaggcgacatacatcctccttggtttacgagctgacaggattaacagattaaagtaaagacaggcataggaaatcataagggtattgattggggaagtgataagtgtccatgaaatcttcagagattgcagtaaagacaggcataagaaattataaaagtattaatttgggaaactaataaatgtccatgaaatcttcacaatccacgttcttctgccatggcttcagcgggtccctccgtttggggtccctgacttcccgcaacacaatggccccaaagctagcaggagaaaagaaataattaaaatcagagcagaactgaatgaaattgggacacaaacatccatacaaaaaatcaatgaaaccaaaagttggttttctgagaggataaacaagatcgataggccactagctagattaacaaagaaaaaaagaggctgggtgtggtggctcatgcctgtaaccccagcactttgggaggccgaggcaagtggatcacttgaggtcaggggttcgagaccagcctggccaacatggtgaaaccccgtctctactaaaaatacaaaaattagctgggtgtggtggcgcacgcctgtaatcccagccacttgggaggctgaggcaggagaatcacttgaacctgggaggtggaggttgtggtgagccaagattgcaccactgctcttcagcgtgggcagcagagtgagactgtatctaaaataaataaataaataaataataaaaataataataataaaaaaatttaaaaaacgaagaaaaaaaagacagaatatccaaataagcacaatcagaaatgacattacaacaagtccacagtgatttaaaaaagatcctcaagatgaacacctctatggacacaaacttgaaaatctgaaggaaatggataaattcctggaaacacacaatctgccaattttgaagcaggaagaaattgaaaccctgaacagaccaatatcaagttatgattctgaatcattaaaaggagtctaccaaccaagaaaagcccctgatcagatggattcacagctgaattctactacatgtacaaagactaagactaatcctcctgtattagtccgttctcacactgctataaaggcatacccaagactgggtaatttataaagaaaagaggtttaattgactcacagttctgcaaggctggggaagccttaggaaacttatagcagaaggagaagcagacacatcttacatggtggcaggagagagagaatgaatgcaagcataggagaaactgccacttttaaaaccagaaatcagatcaggctgggcacagtggttcatgcctatcatcccagcactttgggaggctgaggtgggtggatcacctgaggtcagaagttcaagaccagcctggccaacatggtgaaaccctgtctctacaaaagtacaaaaattagccagacgtggtgatgcatgcctgtgatcccagctacttgagaggctgaagcgggagaattgcttgaacctgggaggcacaggttgcagtgagctgagatcatgccattgcactccaccctgggcaacagaacaagactccatctcaaaaagaaataaaaataaataaataaataaataaaaccatcagatctcatgagactcattattgggagaacagcatggggggaactgcccccataatccaatcacttccctcccttgacacatggggattaaaattcaaaatgagatttgggtggggacacagagccaaaccacatcacctactaaaactattcccaaaaaattgaggagagacccctccctaactcattctaggaagccagtatcaccctgatcccaaaacctggcaaaaacaatgaaaaaataaaactgctgggtatggtggctcacgcttgtaatccctgcactttgggagaactgagggaggtggatccttgaggtcaggagttcgagaccagcctggccaacatggtgaaacctcatctctactaaaaatacaaaaattagccgggtgtggtggtgcatgcctatagttccagctacttgggaggctgaggcaggagaatcgctcgcacttgggaggtggaggttgcagtgagcccagatcgcagcactgcactccagcctgggagacagagtgagactgtctaaaaaaaaaaaaaaaaaaaaaaaaaaaaaaaaagaaagaaagaaaagaaaactacaggccaatatccctgatgaaaatggatgcaataatcttcaacaaaatactagcaaactgaatccagcagcacatcaaaaagttaattcatgaggccgagataggtggatcacttgaggccagaaattcaagaccaccctggccaatatggtgaaacccatctttactaaaaatacaaaaattagctgggtgtgttggtatgtgcctgtaatcctaactattcaggaggctgaggcatgagaattgcttgaacatgggaggcggaggttgcagtgagccgagatcatgccattgcactccagactgggtgacagagtgagactctatctcaaaaaaaaaaaaaaaaaaaaaaacagatgcagtggctcatgcctgtagtcccagcactttcggaggctgaggtgggcagattacctgaggtcctaagtttgagaccagcctggccaatataatgaaaccctgtctctactaaaaatacagaaattagccaggcattgtggcccacacctgtagtcccagctactcaggaggctgaggcaggagaatcacttgaacccaagaggtggagggtgcagtgagccaagatcgcaccactgcactccagcctgggtgacagagtgagagcccatgtcaaaaaaaaaaaaaaaaaggccgggcgcggtggctcaagcctgtaatcccagcactttgggaggccgaggcaggcgatcacaaggtcaggagatcaagaccatcctggctaatgtggtgaaaccccatctctactaaaaatacaaaaaaaaaaaaaattagccgggtgtggtggagggcgcctgtagtcccagctactcgggagactgaggcaggagaatggcatgaacttgggaggtggagcttgcagtgagccgagattgcaccactgcactccagcctgggctacagagcgagactccatctgaaaaaaaaaagaaagaaagaaaaaagaaatcttagatgacaccagcaaatggaaaaacattcgatgctcatgtattggaaaaatcattatcgttaaaatggtatactgccaaaagcaatctacagattcaacattatttatttatctatttattttttggagacagagtcctctgtcacccaggctggagtgcaatggtgcaatttaggctcactgcaacctccgcctctcaggttcaagccattctcctgcctcagcctcctgagtagctgggattacagatgcctgccaccacacctgattcatttttgtattttagtagagacagggctttaccattttgcccaggctgatctcgaactcctgagctcaggtgatccgccccccttggcctcccagagtgctagtattagaggtgtgagccaccacacccagcctaaacattattcctatcaaggtactgtgtccagagttggttccttctggtgggtttgtggtctcggtgacttcaagaatgaagccgtggaccttcaccgtgtgacagctcttaaaggtggcacagacccaaagagtgagcagcagcaagatttattttgaacagtgaaagaacaaagcttccacatcgtggcaggggacccgagcgggttgccactgctggctgtggatggccagcttttattcccttattggccctcccatgttccatttctgtcctatcaaagtgcctttcttttttttttgagacggagtctcactctgtcccccaggctggagggcagtggcacgatcttggctcactgcaagctccgcctcccggattcacgccattctcctgcctcagcctcccgagtagctgggactacaggcacctgccaccacgcccggctaattttttgtatttttagtagagatggggtttcaccatgttagccaggatagtctcaatctcctgaccttgtgatccgcctgcctcagcctcccaaagtgctgggattacaggcgtgagccaccacgcctggcctcatgtacaggcttttgtgcagacctgagtttttagttcatttggataaatatcaaggagctcgactgctggattgtgtggtaagagcatgtttagttttctaaggaactgccaactctcttccaaactggctgtataccattttgcattcccaccaacaatgaatggcccttcctattgcttttcattctcaccagcatttggtgtgtaatttctgaataaaatcctttgtgttttccaagtatacagttattttgatctgaaaataataatttttcctccattctgatttctctgtctctatattctacctcttgtcaaattatattggctaacacatccagaaaaatattaagtaatagctgtaaaaatggataaactgcttttgttcttgacttcaagtttgggagcacttttatggtgcccccattaagtatgatgctgaataattttttgtatttttagtagagatggggtttcaccatgttagccaggatggtcttgatctcctgaccttctgatccgcccacttcggcctcccaaagtgctaagattatacagtgagccaccgcccagcccagagtgcacttttttcaatcctccctgcaattggctacttttaggatcctgctgattggtgcattttacagaacactgattggtgcattttacagcatgctgattggtgtgttttacagagtgctgattggtgcattttacaatcctcttgctagctacagcgtgctgattggtgcgttttacagagcgctgattggtgcattttacaatctgcttgctagctacagagcgctgattggtgcgttttacagagcactgattggtgcattttacaattctcttgctagctacaaagcattgattggcgcatttttacagagtgccgattggtgcattttacaatcctctttaaagacagaaaagttctccaagtccccactcaacccaggaagtccagctggcttcacctgtcactaccaacgtcatttttcaaggaactagaaaaaattattctaaaatctacatggaatcagaaagactctgaatagcgaaagcaatcctaagtggaaagaataaagccagaggcatcacattactggacttcaagctatactacaaggctacagtaaccaaaacagcatggtattggttaaaaaaaaaacaacacctatggtcatctgatctttggcaaggttgataataacaagcaaaggggaaagaacactgtattcaataaattgtgctaagatagttggctagctatatgcaaaagaataaaactggagccccacttttcaccgtatattaaaattaactcaaaacaaattgagaatttaaatgtaacccttcaagctataagaatcgtagaagaaatcctgggaaacaccattctggacattggctttgggaaataatttatgactaaatcctcaaaagcaattgcaacaaaaccaaaacttgacaaatgggacctaattaaagcaaagaacttctgcacagcaaaagaacctatcaacagagtaaacagacaacttacaatgggagaaaatattcataatttatgcatccaacaaaggttcaatatcagaatctataaggaacttaactgaacaaacaagaaacaaatatccccattaaaaatgggcaaatggctgggagaggcggctcacacctgtaatcccagaacttttggagcccaaggagggcagattacgaggttgggagttcaagaccagcctgtccaacatggtgaaaccccaactctattaaaaatacaaaaagtagccaggcgtggtggtgtgcgcctgtaatcccagctacttgggaggcttaggcaggagaattgcttgaacccaggacatagagggtgcagtgagccaagattgtgccattgcactccagcctgggcaatacagtaagactccatgtaaataaataaatatataaataaataaataaaataaaatgggcaaaacacataaataggaacttctcaaaagaagacatacaagtggcccacaaacatataaaaaaatgctcaacatcactaatcatcagagaaaagcaaatgaaaatcacaattagataccatctcacaccagtcggaatagctattattaaaaagccaaaaaataacatgctgttgaggctgcagagaaatgggaacacttatactctgttggtgaaaatgtaaattagttcagttactgtggaaagcagtttggagatttcttttcttttttttttcttcaagacagagtcttgctctgtcacgcatgctggagtgcagtggtacgatctcggctcactgcaacttctgcctcccagggtcaggcaattctcctgcctcagcctccagagtagctgggattacggtcacccaccaccacacccagctaatttttgtgtttttagtagagacagggtttcaccatgttggccaggctggtctcaaactcctgacctaaggtgatctgctccactcggcctcccaaagtgctgggattacaggcgtgatccactgtgcccggcctggagatttcttaaataacttaaaacagaactaccatttgatccagcaatcccattactgggtatacatccaaaagaaaataaattatcctaccaaaaaaacacatgcatttgtatgttcattgcagcactgttcacaatagcaatgacatggagtcaacctcggtgcccatcgatggtggactggataaagaaaatgtacaaacacgctatggaatacttcacagccataaaaagtatgaagtcatgtcttttgctgaaatatgaatgtagcttgaggctgttatcctaagtgaaataatgcaggaacaaaaatccaaatgctacatgctctcagttataagtagaagctaaataatgagtattcgtggatataaggatggtaacaacaggccagatgcagtggctcacgcctgtaatcccagcactttggaaggctgagatgggtggatcacgaggtcaggggtttgagaccagcctggccaacatggtgaaactctatctcttctaaaaatacaaaaattagctgggtgtggtggcggtcacctgtaataccagctacttgggaggctgaggcagaatcacttgaacctgggaggcagaggttgcagtgagccgagattgcgccattgtactccagcctgggcaacaagggcgaagcttggcctcaaaaaaaaaaaacaaacaacaacaacaaaaaaaaacaaaacctgaaaatctaatatttaaaattaagaactcaatgtatagatttaacagcagattggagattatagaagatagactcaataacctgaaaaacagaaaaccttcaaactgaataattgaaaaaaaaattgacatcacaaagtgtaaaagacacggtgaacaagatcaaataatcttacatatgggctgggtgccgtggctcatgcctgtaatcccagcactttgggaggctgaggcaggtggatcaccggaggtcaggagttgaagaccggcctgaccaacatggtgaaaccctatctctactaaaaatacaaaaattagccgggcgtggtggtgggcgcttgtaattctggctactcgataataatactattataatagtattatctacctcagtagataatactgctgaggcaggattatcgcttgaacccgggaggcagaggcagaggttgcagtgagacgagattgcgccactgcactccagcttgagcaaaaagagtgaaactctgtctcaataataataataataatcttacatatgtaattggtgtctcggagaacaggcatagagaatgcagcaaaaaccatatctgaagagataatgattgagaatttctcaaaactgatgcaagacatctacccacaaatcagagaaactcaatgatatccaagacagataaatacaaagaaaacaaagatagggcacaaaataaatggctaaaaatcactaacaggctgggtgcggtggctcacgcctgtaatcccagcactttggggggctgaggcgggcagatcacgaggtcaggagatcgagattatcctggctaacttggtgaaacccggtctctactaaagaaatacaaaaaaaattagccaagcgtggtggtggacgcctgtagtcccagctactcaggaggctgaggcaggagaatggcgtgaacccgggaggcagagcttgcagtgagccgagatggcgccactgcactgcagcctgggcgacagagcgacactcctctaaaaaaaaaaaaaaaatcactgacaaagagaaactgttaaaaagaagtgagagggcctggtgtggtggttcacgcctgtaattcgagcactgtgggaggcccaggtgggaggatcacttgagctcaggggttcaagaccagcctgggcaacatagggagatgtcatcgctacaaaaataatgatagtaatagtaataaaaaattagccgggcgtggtgcaggagcctgtggtcgcaggtaccctggaagatgaggtgggaggatcgcttgagcccaggaggcagaggttacagcgagcctagggtgtgccacggcactccggcttgggcgagacagcaagaccctgtttggaaaaaaaaaaaaaagaaaagaaaaaagaaaaaaaaatcaacagtaattgcagccattgcttagaactaagactaaacaaagcttttgtttggaaaggagtactttttcattaacattgtttagaattttctgacacatgatgataattaaaagcaaaccatcctgcagttggcttcggtattgtttttatcttctccaccatcaatgcatatccttactgcctacacaggctctcagcaacgcactgttggttttccattgcagtcacctccactttattcttccagatcgagtatgttcaaaactgaactcatcttccgccataaatctgctattattatgtttttgcctgtcaggacatcggcttataattttggaaagcattcacagttggggcgggtaagacatagataaagaggccaatcacaataccaggggtaagatcaataggaaaaccagagagcggacgcctgggccaggcctcacaacgtccagagctggaatgggtcttttgctttcggcgcaggggtgacgggatcagcggagggtaggggtgtacactagctgcggtctgatttagcccttttaggttaaaagctggagaaggggctgaagtctcaaacgcgcttagcagctcctgaacgcggttcccatcccagcgcgttctgagggaggccggggctaaggacgcggtgacgggcgggggcggggcggccccgggtcgggaggcggggcgggagcgccggaagcgggcggtgccaggcccagcctcgcaggcggaagggcgcggaggaggtgacgcgataggccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcaggtaagcggggacgcgggcagacgagtgacggactcagcgatcgcctggcggggctggctggggccattcccgcgccggtgcgccacctcagcgcccggtccggaggcctcgagccgccctcccccgcccgagctggaggccgccgtccgtctcggccacagcctccctttccgggggaggcgagcgagctcgtcccgaggggccgctgccctgcgctctcgctccagccgggctgtgcgtcgcaggcaccgggaagctggcgccccccagctcctcctgaagccgggaaagctctgagaggaggagccgctgtcacaggcctccagctccggccgccgtggaagtccggggtttttatttgcttagaccgctctgcctccttccggccttcgtttctttcctcgcgctccccgggacccttttccagagagcccggttgggcatgagcgcggtgggagacgtcttttcccttcggtctgctctgagcggtatcagcctccgctctacgccctgtggccactctgtcggggtggagggatgcggagaggatgtgggagttttggacttagagcgagaatagccgaggtgaaatcctaccctgctctctggtagtgtttttcatctcatgctagatagacatttcgacctttttcaccgcaggtaaagtgggactttcttctaccaatgtaaattataatgtttggagaattaaatgaagaaagcagacgttagttatgaaatgttttgagaatctggttaaatttaatttaagaatatccaggacacttcatgataggttcctacttatgttttttttttgcattttgcccggaataactaagcttggtatggaaaaggttgcctagagatgccaggcgctcgtgtggtcagagcctaactgcagtctctgttttgggtgggcagcatcaggaagaaaccagactctctcctagccatccacatgtctcacgcttattgatggcatattattggtatatgagggatggcttatatcagttttgatctttactcaagatagctttttcccagtgcatcttttctaggagaaaagcttggtatgtagaggagggtgctggggaggggggcttcatttacacctgggctcacaatttttttttggaggggggacagggtctcactctgacacccagcctggagtgcagtggcgcgatcttttcagctcactgcaacctcctcctcccaggttcaagcgattctcctgcctcagcctccagagtagctgggattacaggtgcccgccatcgcgcccggctaatttttgtatttttagtagacatggggtttcaccatgttggccaggctggtctcgacctcctgacctcaagtgatctacctgcttccgcctctcaaaagtgctgggatcagccgggcgcggtggttgacgcctgtaatcccagcactttgggaggccgaggcgggcagatcacctgaggtcgggagttcgagatcagcctaaccaacatggtgaaaccccatctctactaaaaatacaaaattagccaggcgtggtggcgcatgcctgtaatcccagctactcggaaggctgaggcaggagactagcttgaacccgggaggcgaggttgtggtgagctgagatagtgccattacactccagcctgggcaacaagagcaaaactccgtctcaaaaaaaaaaaaaaaaaaaaaaaaaggtgctgggattacaggagtgagtcactgcgcctgggctatattactttctaaatcagcctttttttttttttttggtaggccattatgtgaatccttcaaaaatcatagaaaaattgaaatttaacaatattttgcttttattctagcttgtcataaacccagtgctctatacacaggcctgcctttctgcctccttcatcctggcatgcatggccatttactttgtgttattagccagcttcctatggagctcagtttgagaacggggttctgtgcttctctagttgccaaacatctgattgaagtagatcaccttggcatttgcgatattaagcatgtctttgcgaatttttagttcctttttcttttcttggttagattgtactctgtcactgatttaaagaatttggtagacgctcagaaagggtcaactggtaaggtggtcacagtgctttacatgtatttttcttacctattatggtgaaacccttgtgactttttttgggcgtgggtaatattttcaaaattaaggtaaataggccatcaggctgcgttgaactttctcttttagggaaatatattcattctccaattattctttggtagccttcttattgctttagcaattcctactctattattagtagagccggaaatggaccctacatcacagattctccaaatatactaaattattttttctctaaaatgatcatgtttatagcatgttgattttctttttttttcttttgagacagagtttcactcttgtgcaggctggagggcaacagcttgatctctgctcactgcaacttccgcctcccgggttcaagtgattgtcctgtctcagcctcccaagtagctgggattacaagcgcccaccaccacgcccggctaatttttgtatttttagtagagatggggtttcaccatgttggccaggctggtcttgaactcctgacctcaagtgatctctccgtctcagcctcccaaagcgcggggattacaggtgtgagccactgtatccggtcagcagcatgttgattttctacaaccagatgacaaaggatatcctaaagtcagtgatttaaaaagtcatgttggcttggtgcggtggctcatgcctgtaatcccagcactttgggaggccgaggcgggtggatcacgagtcaggagttagagaacagcctggccaacatggtgaaactccgtctgtactgaaaatacaaaaaaattagctgggcatggtggcgggcgcctataatcccagctactcgggaggctgaggcaggagaatcgtttgaacccatgaggtagaggttgcagtgagccgaggttgcaccattgcattccagctttggcaacagggtgagactctgtctcagaaaaaaaaacaaaaaacaagtgatggtaacacataggttgtctaatacattcagagtctagagagacctggtatgtatctgagaaaccaaatagctgaatctctaaaattttatttttgtgtctggaataccttaattctgaagttttagttgttgttgaatttcacattctgacaggagacaagtagaggtacatgtgaagggttagtatgaacccagggttacagtttcaatctaaactgatactgcagagttaacattgaaacaaagcagctctagggagctggcaaaaattgaaggttagaagtcacttgctggctcttgaggcagtcttctgactctgaaactacttgagactaaaattttcaagaattttttaacttaattttgtaaagatataatttacggcctggtgcagtggctcatgcctgtaatcccagcacttagggaggccgaggtgggttgatcacctgaggtcaggagtttgagaccagccaacataatgagaccccatctctactaaaaatacaaaaattagctgggcatggtggcacacactcgtactcctagctactcaggaggctgaggcaggagaatctcttgaacctgggaggtggaggttgcagtgagtcgagatcaggtcactgcactccagcctgggtgacacagtgagactccatctccaaaaaaaaaaaaaaaaatacagtcaaatacatagaccttaagggtttttattttttaaagcatatgtacacaaaatggaagacagaaaaatagcaaaacattttggaagctggaatgcagattgatttaagcagtctgcccgccttggcctcccaaagtgctgggattacaggcgtgagccaccacacttggccgatataactttttcgtagtgaagcttcagttaacctgtacggtggctgcgctgtgaactttcacccaaatattgggctccttaaggggctgtttaggcttggggctgtcctagggtcggtgagtatctagtaagagtgtaaaccttctatttcccttgtgtgcgtgttttatctttgaaggaatgttgatatttggtcagtatgaacatacagcagcatggctgggaatacaggggcagaaatgtaaaggaaacgcatgtgaagtttgcttttaattactggaccgttgtattcaagaaccttcaatggcagtatcttgtctttgctccagggtcagattccctaaagaagaagggatctcctacttggagagtacaaattgggcttccagcagtctggcttctatacttagggaaaggctggaggtcttagtattcgttatgtaaacactcattcttgttcatttaactcaactattttcagtaagatgacctcattctcaactggaccagttgaaaagctttccagtccaggaattctttgtttttacataggattgttttaagctgctacgtgtggttagtggctaccatattggatagcggagctgcactatccagtgtggtagccactagccacatgtagcagcctaaatctaaataattaaaattaaaggtttagttcctcacttgcactagacatgtttcaagtgctcaatggccacatttgcccagaggctaccgtattgggcagagcagatatagaatatttctgtcattgcagaaattttattgggctgtgctgttctagtctagagaagaagactccaggtgtctgcaaggatgggtaggggacagttggctggttttgtggcatgtgggaggatatttaaatcatttgaccaatccttttatttttagcgtcatattcatattcacatccctctgtagaacaattcctgacctgttttgaggtattgttctttagattgctttcctccctgcaagcttgagatttaactttttttttttttttttttttggagacggagtctcgctctgttgcccaggctggagtgcagtggcgtgaacttggctcactgcaacctccacctcccaggttcaagcaattgtcctgcctcagcctcccaagtagctgagattacaggcacatgccaccatgcccggctaatgtttgtattttagtagagacggggtttctccatgttggtcaggctggtcttgaactcctgacctcaggtgattcgcctgcctcggcctcccaaagtgctgggattacaggcgtgagccaccgcgcccggccccagccgagacttaacgtctttagatctttaagtcaatccacattccaactttcaaaatgtttttgctgttgttcggtgttccattttgtgtacatatgctttaaaaaaacaaaagcccttcaggtttatgtatttcactgtaggtaaattatatctttaaaaaattaagttaaaaaattcttggcagccgggcgtggtggctcacgcctgtaatcccagcactttgggagtctgaggcgggtggattgcgaggtcaggagatcaagaccatcctggctaacacggtgaaaccccatctctactaaaaatacaaaaaattagccgggtgtggtggcgggcgcctgaagtcccagctactcgggaggctgaggcaggagaatccttgaacctgggaggcggagcttgcagtgagctgagatgtgccactgcactatagcctgggtgacatagtgagactccatctcaaaaaacaaaacaaaacaaaaaacataatttaattttaattagttatttaggaatgggtcttgctgtgttgcccaggttggtctcaaattcttgacctcaaaggatccttctgcctcagcctcttgagtagctgggattatagacatgcaccatggtgcctggctggttttttcttttaaaaaattaatttattggctcacacctgtaatcttaggtactcagaaggctaagtcaggaggattacttgattgagcctgggagtttggggcttcagtgagccatggctgacagaatgagaccttttttttttaaaaaaaaaaaaagataaaggacaatttttttattcttaatgaagttttaagagggaatgatggtaaaatgtgtctgcttaatctgcagtctttatccagaagtaaagtgcttcatcagaatttaaacatgtataagaatctccactaaaaaaatgtttgagctttacccaggcttcttgaacaatttttatatatcgccttttttgttccaccttggtttttgtcctttccattgtactaaaatttctcctgcaaatgtcaagagaattcagtgaacacttttaatccttatcttgctcgacttctcaacaacctttaactgaccatttccctctttttagaaacctgttctagctttgctgataccacctttacctgatttttgaccttatctccctggtcattttttttcactttcctttgcttagtctttctttatttcttaaatcctggagttccagctgggcacacctgtaatcccagcactttgggaggctgagttgggtggatcacctgaggtcagaggtcgagaccagcctgaccaacatggagaaacccggtctctactaaaaatacaaaattggctgggcgtggtggcgcatgcctgtaatcccagccacttgggagcctgaggcaggagaattgcttgaacccgggaggcggaggttgcagtgagctgagatcgtgccattgtactccagcctgggcaacaagagtgggaaaaaaaaaaaaattcctagagttccttgggctattgccctagggtacattctctcattctcttctaccttttacaaattctttctaggtgatcttatcattttctatagctttggttactctaagctgaaaactggaattcacatgatgtcctcttttcagaattcttgaactgtatatctagctgtatatatccacttggacttctaatggtcatctcaaattgaacatgtgaaagactaaaggcatagtcagtataaccttcccctaatcgatctccgtctgtgtttcgtatcagtgataccactatctacctagtagctgatactggaacatttacccccaacagataggcttttgacaaatgacaagtcctgtcatttctgtgtcctgaagattgattcactttgctacatcctcccagtttttctcttaatccaagaagctgtcccactgtatctgcattgatttacctgtaacagattcctaatgggtttcttctgctgtggccttctccttgccattctgcacattgcaggtagaatgatttttttcaagaatatgaatcagatctttgtctttcagtggcttcacaccaaccttatgttaagtgtcagcatcgtgaatttagctcttctgttcctcatctaccccttccgtgcctctaagtgttactgaagttctttccattccttgaaatactgaattccctctctttcctaggaactcttgctcatcatttgtctcagctgaaaaataatttcttcagagaaaaaataatttcttcagagaggtgtttcctgacccttttgccagatatttccattgtaccctgaatttgactttttttaatttttattttatttttttatttttttgagacagggtcttgctctgtcacccaaactagagtacagtggtgtgatcatagctcagtgaaactttgacctcccatgcccaagcgatccttccacctcaccctcctgagtagatgggaacacaggcatgtaccaccacttttggctattttttttggagacaggatctccctgtgttgcccaggcaggtgatcttgaaatcctgggctcaagcgatactccacctctgcctcccaaagtgctgggattacaggcataagccaccatgcctggccaatattggcagtataccatagtaagcgtttatttgaattacatgtttatttcatattaagaagtttgtttatatagaagtgatttttccactgataaagtaaaatatgatattctaaactagaggttcccaaactttctctgtttacaccctccttaatatattttttacatgtccctaagcttaacagtttgatttattaaataattaggttcagacagcttaagaagtatttatgggccaggcgctgtggctcacgcctgtaattccagcaggcggatcatgaggtcaagagatcgagactatccttgctaacacagtgaaaccccttctctactaaaaatacaaaaaaaattagccgggcctggtggcgggcgtctatagtcccagctaggctgaggcaggagaatggcgtgaacccgggaggcggagcttgcagtgagccgagattgcgccactgcactccagcctgggcgacagagcgagattctgtctcaaaaaaaaaaaaaaaaagaaaagaaaaaagtatttatgttctttcaacctaattgacatctaagaaatacacaaattggaagacaaagtcagatagatgtgatggctcgtgtctataatctcagctctttcggtgggcggatcacttgagtccaggagtttaagaccagtctgggcaacatagaccgtatttctacaaaaaaaaaaaaaaaaattgccaggcgtggtggtgtgtgtctgctgtagtcccagctactcaggaggctgagggaggattgctggagcctggaaagttggggcgagctctgattgcaccagtgcactccagcctgggtgacagagtgagacactctcaaaaaaataagaaagagaaagacaaaattacattttgatttcattcttaaataaccacagttatttaccgtatatacttgttgggcactacaaaacccaaaccgtggaatcatattggactctgccacccacattgcttactttttaattaaaacaaatttgcttttggctgggcatggaggctcatgcctataatcccagcactttgggaggttgaggtgggaagatcgtttgaggccaggagttcaagaccagtctgggcaacatagtgagaccccatcttactaccttattttattttttttaatttttaattttaaatatttatttagagatggagtctcactgtgtcacccaggctggagtgcagtggcatgatcttggctcactgcagcctccactccctggttgaagcgattcttctgcctcaggctcctgagaagctggccattactggtgcccaccaccacacacggctaagttttgtatttttagtaagagacagggtttcaccatgttggccaggctggtctggaactcctgacctcaggtgatctgccctgctcgaccttcaaaagtgctgtgcttacaggtgtgcgccaccgtgcccggccactatctcgctattttaaaaaataaataacatttgtttacatctttgttttctccactcattttttgctctaaattgatatttgcacagtatttttttttaaatcacagcaaccaatagatactcagctttgcaaagattatgatatcatcaaaaggaacatagtgtgatctattttgaagctgaactgtcttgaactagtagtttataaggtgtttgacaagtatagaagattactttttccctgtaatttagaatttcctgttgtgctctcgtgagttctctacagaatcccaggttgccttgggcacagtttgggaactgtgatcctaaacttttgatagtttggtgtatatgcttttagacatttttctccaaacattcaagcatatgcatatatttttccttttaacaaaagtgggctggtacatattggtcagcaacttcattttttccattcagcagtgtatcatggtaaaggtggtggattgaatatatacgtttaattttatgccagcctgaaaatttcattaaaacaatggaggacttaaaaaccctctagataacaaagaacaggaacaatgagaataacaacaatatcgtgaaagctggaaagcagaaaagactaatggcaactaattcgccaacttgagaaagctgtatcctaaaccaacagtggagagagccttcaaatagtcatgttatgttaccaaaccctttaaaagtctcaagattagctgtgtcctgtactgtggaggtggaggtgggacagaaaatatgaggagttgtttgaaagtctgtttcagaaaagtttccactcctgacctccctttcttctccccgtagacataaatagggtaactagagacttactatctggagtagaaaacgattattatctggactgagggataccatgcatagttaaggataaggtactgtgccttatagtggaaatctatatgctgaaggtagaaacctctagctttttttcctgacatagttctcagaatcttgcccctttctgctgtttcccattcaccaaaagcagcctctttcaagtctttgaggtattgttttggtataaacaacatgtctttaaattacctttttatttttatattttatgagatggagtcttcctgtcacccaggccagagtacggtggcatgatctccgctcactgcaatctccgtctctcgggttcaagtgactctcctgcctcagcctcccgagtagctgagattataggtgcccgccaccatgtctggctcatttttgtatttttagtagagacaaggtttcaccacgttggccaggctggtctcgaactcctgacctcaaatgatccgcttgcctcggcctcccaaagtgctggtagtacaggcatgagccaccatgcccggcctaaattacctttttataatgtaacttgtgattacttagtttatgctttatctgttgacttgaagatgaagattgttcttttttacatctgttccccacgtctgtgtacttgcatacttcttatcttccctccaagataccactgtatcttcccactatagggatgctataaggggcagtattaccattccaggtgagataattcttcattgttgtgtttattgcatgatacttagtatccttggaccccagcggtaaatgtcaataccaacctgaatgtattacagcaaccaagaatttcccacacatttccaaatgttaggttgaggtggtatggagtatctggttgagaagcactgggttagatcagtgtttagcttattactattatgtaaatggtagtcatagttaagccatgtagtataccaaggtttacaaccactgttttccctttcttgtacatttttctgttgtccctgaaattaattgtctttatcttttgtttagtgttctctgtacctactactaactgcaaactctcttctggttgtctgtttctcctttatttgctttcatacactttagaaattctatcaggatcacattcttggagccttttgactgacttttgaccgctcccttctggattggtggccctccaggcttaaggcacattgtcattctgcatctatttttactgttatctttagtattctttttgcctgactcttgtttttggatctcatttcctgcatcctgtgtattcttgacttactcccatatttgccagagtaccttctcctgtgactctctgagaaggatgcatgggaggtaaatattttgataacttacatctctgtaaaccttttttgttagttgttatgttagtttcagtctgtcattttgtggtactttctgggagattgctcaaaattttaaatgttttaatgttttacttttaacttcgaaataacttcaaatttaccgaaaaaaattgcaaaatattacagtttttctatatgcttcacctagctttgctccgaagttttgtttcagttttttttgtttgtttgaagacatggtctcactctgttgcccaggctggagtgcagtggcgtgatctcggctcactgcaacttctgcctcctgggttcaagtgattctcctgcctcagcctcccgagtagctgggattacaggttcatgccaccgtgcctggctaatttttgtatttttggtagagacagggtttctctatgttggccaggctggtcttgaactcctgaccttagttgatccacccacctcagcctcccaaagtgctgggatcacaggcatgagccactgtgcccaaccttacttcagtttttttaaggagacagagtcttgctatgttgcccaggctgatcttgaactcttgggctcaaacaatccttctgtctccgcctcccacgtaggtgggtctacaggtgtgcaccactgtacctggcctctccaatgttatagaactgcagcacattgtcaaggccaggcaattaacgttgagagaatactgctaactgatctgcacaccttattccaattttgtcagttgtcacatgacttttctttttctgaactgagactcaatccaggattataccttgtttaattgtcgtctccttaatctcagtctttcattctaggacagtctgtctttgtctttcaggactttgactgatgtgattgaagagtattagccagttattcttttttttttttttttttttgagacggagttttgcttttgtaccccaggctggagtgcaatggcgtgatttcggctcactgtcacctgcgcctcctgggttcaagcaattctcctgcctcagtctcccgagtagctggattacaggtatgtgccaccgtgcccggctaatgtttgtatttttagtagagacagggtttcaccgtgttggccagactggtctcgaactcgcgacctcaggtgatctgcccacctcggcctcccaaagtgttgggattacaggcatgagccaccgcgcctggcccttttccttttttattttttttttgagataggacatcactctgttgcccaggctagagtgccatggtgcaatctcagctcactgcaaccacaaactcctgggctcagttgatccacccacctcagccttctgagtagctgggaccacaggcacatgccaccacacttggctaatttttatatttctttgtagagatggggtttcatcatgttgcccagagtggtctcaaactcctgggctcaaacagtccacccatctcagcctcccaaagtgtgagattgtaggctgagccacagttccctgctggttgtttttaatattttgctattataaacaatgctgcaatgaatagccttgtacatgtgtatatttgtattattgtaggcatgtcttcaggtaaattccttaaagtggggttgctggattaaaaggtaaatacttttgtagttattaaatgttaccagattaccctccaaaaagattggatcaatttgtagtcctcctaacaaagtgtggaaaggcccttcttccccaccaagagaatgtgttataatttttgccaattgtcttataaatgaatttggacatctttcttaagcttaaggaacatttaaaaagctttatttgtaaattgtctccttatgtatttttcctattttccattaggctttttttcagttatctcttaatttaagaggtctatatattagggatattaggcctttatgatacatgttgcaaatatttttttctaatttatcagctgtcttttcattttgttcatttattattttttttaacttccaagcttaattgagtttttaatttctgctattatttttaattttcaagacccctttcttgtttttggccattcctttagaaaaagaataacaccctgttcttttttttcaatggatgtaatatttgcttttgcttctttgagatagtattagttttttttttttttttttgagacagtcttggtctgtcacccaggctggagtgcagtggctcaattttggctcactgcagccttcagaactcccaggttcaagcaattctcgtgtctcagcctcccgagtagctgggattacaagcacgtgccaccacacctggctaatttttttgtatttttagtagggttggggttttaccttgttggccaggttggtctcgaactcctgacctcaagtgatccgcctgtcttggcctcccaaagtgctgggattataggtgtgagccaccacactcagccccctctttttttttaattgtggtaaaatatacataacataaaatttactattttgaccatttttaggtgtacagttcattggcattaaagtacattcgcattgctgtgcaaccatcaccaccattcatctccaggaacctttttatcttcccaaactgaaattctgtacccattaagcaataactcccttttctccccctccctgttggtttataaaagttgactttatatagtttttgcttttatctgtttgttttggtctgtttttatccctagacatctggtgattcttggtcatcctttattttttattttatttttttgagacagagtcttgctctgtcgcccaggctagactgcagtggtgcgatctcagttcaccacaacctctgcctcccaggttcaggcaattcctgtgcctcagcctcccaagtagctgggattacaggcatgcaccaccatgcccagctaatttttgtatttttaatagagatggggttttgccatgttggccaggctggtctcgaactcctgacctcaagtgctctgcccaccttggcctcccgaagtattgggattacaggcgtgagccaccatgcccagcccgtctagttgtttttaataatgaccactaagaaactgcttgggaactcttaacacatggtggaatgtgtcaactttggggtacactgtgggccattttgtggggtaatatctgtatctttatggattttttttttttttttggtggactagttatagtctccagaaaagaatcttcagtctgcttgtatgggtgagacagactgctagcattctgggagatgagtggcaaagtgtgttcggagtctcatatgcagtatataattccatcttcaaattatgcctggagtccctgtgtctgcagactttccattttactcttttttgcattttacatttcactattttatctaaaggataaacttccaatcttgggtgggggagggtcacttacctgccatgtggagttaagtagggatctggagtctaactgcttcttaaactttaggccaccctattgagtcattgttcagacttattttgttgtgacatccccaaatatcactatctgttggttttttctccgtgaatgatctgttttcccccagggactagtcgccttcttgtgggtatagagcttcttgccagtcttatggaagctgagtggggaagggcctggaggggaattcacggtgtaaactcatttatcctcctggtatacccctgtgctcagctgtacatgatatactggactatcctgggtcatcctcctcagaaagtgaaactttcatcatctgccacggtaggagatggtatctaggagtttcactgcttcttattcagactttgagccagcgtttccttttcaacaccacccatactcctgactttcataggtatatgttgcctctgcttctgagcctttctgctttctgaggtcctatagctgctgcttttttttttggagacagagcttcactcttgtctcccaggctggagtgcagtggcgcaatcttggctcactgcaacctccacctcccaggttcaagcaattcttctgcctcagcctcccaagtagctgagattacaggcactcatcatcatgcctggctaattatttttgtatttttagtagagacggggtttcaccatgttggccagtctggtctcgaactcctgacctcaggtaatccatctgcttcggcttcccaaagtgctgggattacaggcatgggccaccacacctggccctgtgttctcatgtgtaaaatgaaggacggggaagggagaggagaccaaataccacttaagactgattccatattgacttaattataatttgctcatagcaaaataattagtttcatacagcagatttttaaaagagcaggtacttttgttctgtatagtcatgcaccagtagatatttagtaaatacatgtgaggtcagcatctcaagagggaagccacgctcctctgttaccagtcaaagactctgggtagccatgcaaggacaggactttatcaaatgctctcacccagtgatggttctggatctcaagtgaatataagaaaaaagaaccaacacaagcatacacacatatactgcaggaacacactctagaagtagatggaaatgaatgacagtcaaatccaaacaataacttcccctcaggatttaataaaatctaatattagcgaaggctctttagtctagaaagaaaggcaccagtcactgcaggtagagtggaagaaagactatgaaacagaagccaatattctaatttcagcttgacaacagtttactcagaagtgctgtattacctttctgtgtataagttttctctggggaaaaaaatggaggactgaacacatgtttacctcagttccctctccaaatcacactgaggttacagaaatcagtttttttttgttttttttttttttgagatggagtttcgctcttgtcacccaggctggagtgcagtggcgcgatttttggctcagtgcaacctccacctcccaggttcaagcaattctcctgcctcagcctcaccaggagctggtgtcaggtgtgaggattacaagcaatccttgcaccttggcttcccagagtgctgggattgcaggtgtgagccactgcgcctggtcgaaaatgattcttaagtttatttttctcagaggcaggtgtacagcaaatggctttttgttagactactcatgtcctccctcctctccagttttcattgtgatgaaaaccttggtcagataagatttcattgtgtccaatagtctaaattgaagtatatgtactctttttttttctcaattttctgccttagttactgtgaatatgtcttcatgaccttatttttagatagaaatataacttacttctcttctttacagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaaagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggtatgcacttttcctttattctccctcaaactccaagctcacatttgctgtgcattatccttgctaataagagtcctatttttttctcccactcatgaatatttctttaaaccagttagtctgcttgaagccttttatattgctgcattatgtagatgttccatcatttaatccttgtagacacttgcattgattccatttttttcataagctaatagtgcgatgaaattatgtctttacatttatacatttgtttctgtaagctaaattctcattattagaattgatggtgaaggaatattcacacttaaaattttaagataattaagttaccctccaaaaagttgaaccagtttacatttgttaagctttggcagtcttacagatcacagagttttgttttaatttgcatttttgagttttaagtttgaacatctgtttctgtgtttattggccacttttttgtatgtgcatggttttcctttgcctatttttcttttttttgagatggagtcttactctgtcgccaggctggagtgcaatggtgagatcttggctcaccacaacctccacctcctgggttcaagtgattctcctgtctcaaccccccgagtagttgggattacaggcacccgccaccatgcctggctaatttttgtatttttagtagagatggggtttcaccatgttggccaggctggtctcgacctcctgacctcacgtgatccacccaccttggcctcccaaaatgctgggattacaggcgtgagacaccgtgccctgcccctttgcctatttttcaactggattgtttctgtttttttttttttaatataggagacgctcaatgtaccaggcactgtgctggttcctaagaatgtagcaatgaacagaatatatgaccttcagggaacttggtgtcattctagtcataaaaatgtttaattgctgattataaatgtcataagaatggtccctcacgaaaggtaaaagccttcagtaccccaaaattgtttgatatttttgcttaataggagttttcagttcttacatagtaaaacttatctgtctttttttattttttattttttggagatggagtcttgctctgtcacccaggctggagtgcagtgacgcaatctcggctcactgcaacctctgcttcccggttcaagcagttctcctgcctcagcctcccaagtagctgagactacaggcacacgctaccatgcccggctaattttttgtattttagtagagacagtgtttcaccatgttgcccaggctggtctcgaactcctgagctcaggcaatctgcccgcctcggccagtctgcctaaagtgctaggattacaggcatgagccactgcgcctggcctaaagcttacctatatttgactttgaggcttctagtttttacgtcatgctttaagaagccttctcttgtcaaaaatctatcccataaggtaaactggtgtaaacatttctttggaagacaatatgatagtataaattatggcccattcaggcaatagtttgctagcagctgtttaagaatatagatctatattttgatactgaaagatgtctatataaagtgaaaacaggccaggtgctgtggctcacgcctgtaatcccaacactttgggaggccgaggtgggcggatcacctgaggtcaggagttcaagacgaggctgatcaacatggtgaaaccccatctctactaaaaatacaaaaatcagccaggtgttgtggtgcgtgtctgtgatcccagctacttaggaggctgaggcagggagaatcgcttgaacctgggaggcggaggttgcagtgagcttaggttatgccaccgtgctccagcctgggcgacagagcgagactctctcacaaaaaaaaaagaaagaaaaaaagtgaaaacagtaagttgcaaaatggtatgaaaccattttgttaaaagatatatatgacatatgtaggatgagtgtgagtatatatgtgtgcatatgcatttgtataggacatctggacagatattattaccattggctttggggagctagttaggaggtttatttcttggtagttgaaacagttctgagcactttctctttccaaccattaagtataataaattcttctggctgggcacggtggctcatgcctgttatcccagcactttgggaggccgaggcgggcggatcatgaggtcaggagatcgagaccatcctggctaacatggtgaaaccccgtccctactaaaaatttaaaaaattagccgggcgtggtggcaggcgcctgtagtccccactacttgggaggccaagacaggagaatggtgtgaacgggggaggcggagcttgcattgagctgagatcgtgccactgcactccagcctgggcgacagagcaagactctgtctcaaaaaaaataaaaataaataaattagtaaataaattcttcctcatagaaagacacaaagtacagagtcctagcaaattaaaaaaaaaaacaacaccaaaaaacctcttgtctatactgtcctagagtaaagccagatttccctactgaggttagcagacccatgatacttacacctgaaaagaattagcatttacccacaaatgccagttaacctttatagatgtaacactttcaagtacggttgataaattgaatatgcacgtagtaaaacctgtagcatgacctgaggaagtaggaattcttacagaattcatgtgtagtgacaatataattcactattttaataggccaaaggggaaaaaaatggtatctcagcaagtgctgaaaaacctgttagtaaaattgtttccttttgggtttaaatctcttagaaaactagtaataaaggaagcttccttgaattactaaagaatatcaatcagaagccaatagcagtttcaggtttaagagaatgaagtaagctcatggactctcttcttcctcctaccaaatccatagaaattatgaaaaaatattaaaaacacatgtgtcttcatactcacaaatgaggagacagttttggtagatcagaaactgagaatcagctcccactgggcaaaaagtagagggaaggtccaggcgggcagaaggaagattagtacagggaagtggtgtgatactgagtgctcatatttctggagatggtggaagtggagaggaaaggggacacccatggtaaggactgagtagttggggaatctctccctgcctgtgccacatgtcagcaaagaacaaatctgttatcaagccaaaattctaaggacaagagacaggatactcacccacacacgtacaccttgtaacacttggcaagagtgaggaacatccattttcagaacagctgctggggttcttagtgtccttattcccactgaaaatagttcaaggcagagcagcagctactgcccattatagccctttgccctcaattctcagcaagttacctaagtagagatgaactaacagtctatcaccatcctctgagaaaagccaacacaatgaaatagacaaattcagcaaataacagaactaaacctcagtattgattaatggggcaatgagtacaatagataatcctttaagggacttctacaacattagccactattgagttctgtggggtgctgaatgctggcttgtctctaatatgactgcacattatgctcctttcagttgatttacatgtttaagagtcagttatacttaggggagatttacttgttgcagtttcataattttattcagtattacataaaatgatgaaatatgagtgtaagaagaaagctcctcctttgaaaaacaaggtgaatactttgcaatgacagtagcgggttgctgcaaaaaaatgaatgctgatgcgctcatgcaggacagctgcaaaagatttgagggcgtgcgtgaaagtctaggactctgcactgagattactttgcaagttctttaagttcttgcttcgctttaaagttctaacctctatgtcatgagtatgccaggagataatggaagggaaactgaagaaattaggaatgttttctagaactgaaaagaaaggtctgagtctaaagttgaaaggctttgcaagtgccaatcaggattaaaacacacaaatacatacacaaactcacactaaatttagtgtagtaaaattatagcacatccaagagaaataacttggatggttacttcttttggagggaaaagggatagattcctgtgccgcaaaacattccagatggattaaaagtttggctaattaaaaccaaatacacagaaatgtgtacacgaatgcttgtaacagcattgttcataatatccagaaagtgaaaacaacctaaatgttcaacacctgatgaatggataaataaaatttggtatatctatacaatggaatattattctataaaaggaataaacaccgatatatacttaaatgtggatgcaccttggaagcatgctaagtgaaaagccagacacaaaaggccttataacatatgatttcgttcatttgaaatgtccagaataggcaaatacatagagatataaagtagattaatagttgccaggagctgggaagaaggggaatgagaggtgactgttaatgggtatagagtttctttgtggggtaatggaggtgttctggaattaggtagtagtgatagttacacaatctgaatatattaaaaaacagtgaattgtgttctttaatggggcaaattttgtggtgtgtgaatcacatctcaataaagctgttaaaaagaaacaaatataggccggccatggtggctcacatctgtaatcccagcactttaggaggctgaggcagaaggatcgcttgagggcaggagtttgagaccagcctgggcaacatagcgatataaatacatagagggatgtatatagatttagcgagactctattgctacaaaaaataaaattatctgcatgtggtggtgcatgcctgtagtcccagctcctcagatggatgaggtgggaggactgcttgaagccaggagtttgaggttgaagtgagctatggtagctcgactgcattccacgctgggtgacagcaagaccttgtctctctcttttttttgagacggagtctcactctttctcccaggctggagtgcagtggcgtgatctttgcttactgcaacctctgccttctgggttcaagcgattctcctgcctcagcctccggagtagctgggactataggcatgtgccaccacgcccggctaattttttgtatttttagtagagacggggtttcactgtgttagccaggatggtctcaatctcctgacctcatgatccacctgcctcagcctcccaaagtgctgggattacaggcgtgagtcaccgcgcccggccgaccttgactcttaaaaaaagaaaaaaaaaatacaggaaatcattctttttaagtttttggtttctttgtttgtgacagagtctccctctgtctcccaggctagagtgcagaggcgtgatctcagctcactgcaaactccgcctcccgggttcaagcgattctcgtgcctcagcctctggagtagccaggaccacagaggtgcgccactatatgcctggctaattttttgtatttttagtagagatggggtttcaccatgttggccaggctggtcttgaactcctcacctcaagtgatccgcccggcttagcctcccaaagtgctgggattacaggcatgagccactgtgcctgacctaaagattatttttaattgacaaaattctatatatttatggggtacaatgtgatgttttgatatatgtttactttgtgaagtaaatcaagataatcagcatatccatcactcacttcgtcgtgagaacatttaaaatcaattctcatctattttcaagacacagtacattattattaactatagtcaccagactgtacaatagatctctaggaccacttcctcctgtctaacggaagctttatgacccttgaccaacatcttccaattctctgccccacccccagcccctggtaactaccgttgattctctacgtctatgagtttgactttagattccacatgtaagtgagatcatgcagtatatttttttgtgtctggcatatttcacatattatgctccagattcatccatgttgcagatgacaggatgttttaaggctgaattgtattccattgtgtatatatactacattttctttctccattcatccactcatgggcattgaggttgatgccatgtcttggctattgtggatagtgccgcagtgagtatggggtgcaggtacctcttcaacacactgattttattgtctttgaaatacactcagaaatggaattgctggatcatatggtagttctatttttaattttttgaggaacctgtatactgttttccttcatggctgtgctaattcacattcccaccaacagtgtacagggttcccctttctccacattcaagtcctttgcctgctttttaaattgggttatgttcttgctattcgttgtttgagcaggagaccatttttataatcttatattgataagacatttttgcccataataggaagctcagaagcaatgaaaatataccaaattgactctacagacatttaaatcttgtgtgcatgtgtgtgtgtatagcaaaagttagatgaaaatttaaaaatttagatatgcatgcccttttacccagaaatttaacttgtagtaggtgtgtccaagggaaacagtagaactaggatagatcaagagttttaattgttacattatttagaggtaaaaataaatggccatcagtagggaattggttacaatacagtatgcattttttcaggcaaaagagaactgtccatgatatagtgaatggaaaaaagcagcttcaagaagagtaagtttaggccgggcgcggtggctcatgcctgtaatcccagcactttgggaggccgaggtgggtggatcacctgaggtcaggagttcaagactagcctgaccaatatggtgaaactccgtctctactaaaaatacaaaaattagccaggcatggtggcatgcgcctgtagtcccagctacttgggaggctgagacaggagaattgcttgtacttgtgagttggaggttgcagtgagttgagatcgcaccactgcactccagcctgggtgacagagtgagactctgtctcaaaaaaaaaaaaaaaaaatttagtgtgtttaagaaatacatgttcaaagggcttgaaagtccagaaggaattatgggctcactgccatttatttaaaaatatttatggtcgtgtatgagaaaaaataactacttaaaaggttgtttccacatataaagtaaatgtttataaaaatgtccaactctttttttctagatattaatgtggtttttttttttttttttttttctggagacagagttttgatcttgttgcccaggctggagtgcagtggcgtgatctcggctcacggtggcctccacttcctgggttcaagcaattttcctgcctcagcctcccgattagttgggatgacaggtgcccgccaccacgcccggctaattttgtatttttagtagagacagggtttctccatgttggtcaggcttgtctcaaactcccaaactcaggtgatccgcccgccttatcctcccaaagtgctgggattacaaatgtgagctactgcccccggcctaatgtgttatttttaatttagtgctttggaaaaaagttaaggtagatccttacctcattctttacaccaaaatgaattccagctgttaataaaatatttagttgcgagttctttttttttttttaaatttattcccatgggtctgggaaccaatgaaattagttggtagttctaatactgtttattgagtgatttgctcttttccctgtggttcagaaatgcaacctaccacagagtctctttggatttgatctctattccatgctggctctatttgccttaattagcgtagttttatcatttgacaggacctggcgctccttattcacctctctcctttaattcttttcaaaaatttctaggaatttctcacatttttgtcccaaggtaaattttggatttattttgtaatcttttaaaaaagtatggtttttacttgttgttgcattatatttatagattaatttagggacagttgctttcattgcaaaagacttcctgtcccttagtcatatttcgcatcttttcacttaggttttgcgcattgcttatgtttgttcttagatactgtataccttccttactgctgatgggcccgttctgaggtatgcactgtgttttgttggagaaccatgtgcttgcatttcttacgtgcacagcacggggaacctcattccacatccagggtggaatgtgacccaggtcagttgcatcaaacgaaaactgtccagtgccgttagtttaacatgatggctacttttaacttctttttttttttttttttttgagacggagtcttactctgtcacccaggctggagtgcagtggcataatctcagctcgctgcaagctccgcctcccatgttcacgccattctcctgcctcccgagtagctgggactacaggcgcccgccaccatgcccggctaattttttgtattttttagtagagacagggttccaccatgttagccaggatggtctcgatctcctgacctcgtgatccacccgcttcggcttcccaaagtgctgggattacaggcgtaagccaccgcgcccggccttactttaacttcttttttttaaaaagttcttttttattttttcagttatttttgaggcagggtctcgttctgttgcccaagttggagtgccgtggtgggatcttggctcactgcagtctttgcctcccaggctcaacccatcctcccacctcaccctcccgagtagctgggactacaggcatgtgccaacatgcttggctaatttttgtattttttgtagagaagcggtctcactttgttgcccagactggtcttgaacttctgagcttaagcaatccttctgtctcagcctcccaaagtgttaggattacaggcatgagccaccgtgcctggccgggtactttaaattctaaaatgacacctcaggttttgttttttatattactaccttttgtacttgcagagtgctctgtaatttgaactccagtttttgtttgttgtttattcctaacattttatcctttgtttcttgggtcactttgaaattttagtactttgggagtaaaataaattgtgtataccaattgcatttttccttttttagttgatcagtttagtgaaagcaagtgggtaaagaatggtggatttaactgtcattttataaaatctgtttctgagtaaaataaattgtatataccaagtgcatttttccttttttaattgattagtttaatgaaagcaagtggataaagaatggtggatttaactgtcattttataaaatctgtttctggatagttcttggcccacagatattaaaaaggaaaggtgaagaaccaagttgtttttgtagagaaaagataacagatatttcttgctttgtaagtggcatgacatgatagttaacagcccagtttctgtagtcacggtacctacaatcaggatcttagttctaccatatgctagttaagtgcccttggggaggtaacaacctctcaaagcttctaatgtctccatttgattgactggttgattgattgattgattgagatgaggtctcgctctgttgcccagactggagtgcagtggcataatctcggctcactacagcctctgcctcccaggttcaagcgattttcctgcctcagtctcccaagtagctgagattacaggcacgctaacatgcccggctaatttttgtagttttagcatagacagggtttcaccatgttggccaggctggtcttgaattcttgacctcaggtgatccacccgccttccaaagtgctgggattacaggcatgagccaccgcacctggcccagtgtctctatttgtaaagtagggatactatcttaacacccagggaggctataagaactaaatgagacaggctagtgcttgtcttatgagtattttttaactgttgttttacttctggtcccagtgagataatggtgtgtgtaagtgagacactgtcatctagggttctccttgaagatcgtaccttgaagggcatttctaccgaataagaaatccatgtttatcatctgaaaatgaaaataaagatacagataagaggaaaatgtgtaataatttagaatctccatcattctaccaccagaaataacattgttaacaagagcaccatgatactagtttgaaattcacatccatatcccattgtgggggacactgccttcttatttgaggagcctcaatcaaagttgtggggcctaaagtttaatttttattgttgttaggggtattattttacaacgaaaaataattctcaatgcagtttctcaaatggtgggattccttatcttccactgggcccattcccccatgtagacacaaggttatgattaggtaactgtaagatgtgaaatagtaaacactagaggcaagtatatggtctgttcctagattagaagccccaaatctttatctgataccctgatgaagttggagcatgggactatcttcctgtctactgtatttgcccaaagcctagagcagaatggacgtgagaaaggacctcttttctgtttactgtaccctgacctttgctcctatgttaagccttgaaaattgagaggtactctggtgggagattaacaggaggaaaaataaattgttcacttctttgtctgtctctcccctcataaaagacaaaacacttcattcccaagacactcttatcatcttttctatcctgtttatatcaatgcatggcagaggccattcttggagttacaaagggagctggttaagatatgtggctaacaatcctcatttttcctgtcttaactcagcagacttaaccgtcagactgatggttagctaatttgttgctctgcccattcagcattggtgaacaacctaagtcatgtctgtacttctgtgagcgtctaagccttgcctcagcttttttgtatttacttagaaataatgtcctgggtggccaggcgcggtggctcacacctgtaatctcagtactttgggaagacaaggcaggtggatcacctgaggtcaggagttcgagaccagcctggccaacatggtgaaaccccgtctctacaaaaaaaaaaaatacaaaaattagctgggcgtggtggcgggcgcctgtaatcccagctactcacgaggctgaggtaggagaatcacttgaacccaggaggggtgggttgcagtgagccgaaatcgcaccattgcactccagcctgggtgaaaagagcaaggctttgtcttaaaaaaaaagaaaaaagaaaagaaagaacgtcctgggtttatttcctggggcttttctaggttcagtggatcattcagggatatatataagcacatatacatgttacttacatttacctgaagactgtcctatggtgtggccaaaaagccacctttaaattttatttctcatcttgggaggctggagcgaaaggatcacttgaggccagaagttcaagaccagcctgagcaacatagcaagaccctcatcttaaaaaaaaaaaattaaaaaattagctgggtgtggtttcacttgcctatagtcccagctaactatccaagcaggaggatggcttgagcccaggagtttgaggctgtagtgagctatgattgtgttactatgccccagctgggatgatagaaagagaccccatctccaaaaaattctatttactgtcttaaaatgtgcttcactagctgggtgtggtggctcacgcctgtaatcccagcactttctgaggccgaggcgggcggatcacaaggtcaggagatcaagaccaccctggctaacacggtgaaacccctcgatgatagttccattcgattctatgcgatgattccattccattccattggaagatgattccattcgagaccattcgatgattgcattcaattcattcgatgacgattccattcaattccgttcaatgattccattagattccatttgatgatgattccattcgtctctactaaaaatacaaaaaaattagccgggcgtggtggcaggcgcctgtagtcacagctatttgggaggatgaggcaggagaatggcgtgaacccgggaggtggagcttgtagtgagcagagatcgtgccactgcactccagcctgggcaacagagcgagacgccatctcaaaaaaaaaaaaaaaaaagtgcctcactagctgttatccagttgagctcacctcacagcgttatttggtgtcatgagtataataacttatcaagatgtatgatattgtcccttgctgatactaaagtacatacctttaccaaataatagagtcacagtgatctcatcagttaatgctaattgtgattttaaaataataattctttcagttaccaaaaggataggcacatttgactatgtgattaagccctttagaagtcacgctttaagagaaggttaagctgtgggaagctgttagtatttccttctagctatccattccttctctaacaatgcttcagtaacttaaaaatctaatgtgaaatgattcctcacagtatgtctctctagattgcattggttagagcctaatatattttattttttacaaaagacataactttaaaaatatagtatcaatattatatagtaatataggttaaccactgtatgtgttaagtgctgtgtataggttaagtgtttggagaatgactctactgaaaatggcttgtttttccatcttaacttttctttcttcctttatttaaggattcctagatgaggttatgaagaagtatggcagtttggttccactcagtgaaaaagaagtccttggaagattaaaagatgtctttaatgaagacttttctaataggtatataaatgatgctaaagttaagcccttgaaaataaaatttttggcatatatgacttttctcttgatttacagaagaaaagatatttagcagtaaattgagaagtactcatgttttttttaccttttgtttcaaaatctttctctttcagaaaaccatttatcaatagggaaataacaaactatcgggccagacatcaaaaatgtaacttccgtatcttctataataaacacatgctggatatggacgacctggcgactctggatggtcagaactggctgaatgaccaggttagtatattgtagtttttcagtgtggagaagttgcagaggatgttagtcaataaaatataatctctagtttggcttctcagttgtcttttggaataaggattcttcattctttactggttacttgccccaggatccaaacggtttgattactattggcagtaataatatattatttattctgattgggatgtactgaattgtatagggttagtagcctggttttatttatttattttgtttttctttctccaacttaactggcagagatagtaagctggttttatgttgactttttataggtcattaatatgtatggtgagctgataatggatgcagtcccagacaaagtaagtgaaaacttcctcttctgcaggagagagtgttcttgtgtattaaaatgagtagtttttttgtttttacatttgatgtaattatctgacattccttaaattttttaaaagaagagttcaattttttcttgatcatgtactgggcttgatcgtaagttccatcaaatcacttctttttgttctttttgagatggagttttgctcttgttgcccaggctggagtgcagtggcgtgatctcggctcattgcaacctccacctcccgggttcaagcgattctcctgtctcagcctcccgactagctgggattataggcatgtgccaccatgcctggctaatttttgtatttttagtagagacagggtttcatcatattggtcaggctggtctcgaactcctgacctcaggtgatccacctctgccttggtctcccaaagtgctgggattacaggtgtgagccacagcgcctggccccatcaaatcacttcagcataagaaaatcactgtgcaattgttttcctatttatttgtgttagggtaggtatgtttgttgatatctggagagggcctttttttggtggggagatgtgcaaaagggactggctaagctttttacatttatgtatttattttacttttttttttttttgagaccgagtcttgctctgtcatccagactggagtgtagtggcgtggtcttggctcactgcaacctccacctcctgggttcaagcaattctcctgccttagcctcccaagtagctgggattacaggtgtgtgccaccatgcctggctaatttttgtatttttaggagagacaggtcttaccatgttgggcaggctggtctcgaactcctgacctctggtgatccgcccacctccccctcccaaagtgctgggattaaagatgtgagccaccatgccaggccagctttttacatttaacttaaaatcttgctctctttaaaaatgtaaaaaaaaactcatctttcatttttccttagataaatctttgatactcagttcaaatacagattgaaccctcataaactctaaattctcttaagagttttgttacatatcaaaactatttttttacttaatgtatttttctgagtacacaaatgcctgatgggtgcaaaaatttccaagtgctgtataaaacttaccaatctaataaagtaacataaatactaaaaagtcagattctgataccgtttatgaatatagaaaatgttttatgactttccacttaaattataaatctgttatacatttataaattggaatcatgaggctaatctgctagatgctctattgtcaaattctcttaatcatcagaaagtttaaacaatatagattatctttaacataaaagtattaatttcaagggtttcatttaccaccattgtacatttaattctaaacattcatggagtcaaaaggacacttaactaaggcagtggttctcaaagcatggtccccatactagcagcatcagtatcccctgagaacttactagaaatgcacattctgagactccatcccacacctactgaatcagaaactggaggtgggggaccaccgatttgtgttttgacaagctctctagatgattctgatggacaccaattttgagaatcactgctctagagacagctactataagctctttcttatttatttgtttttattaaaattataaaacataaccttctttttagagacactaaaaagacactccaggctggaatgcagtggcacagtcatagctcactgtagccttgaactcctgggctcaagcaatcttctcgccttagcctcccaggtagctgggactagaggcatgtgccactgtgctactatacccagctagtttatttttatttttggtagagccaggagtcttgctatgttgcccaggctagcttgagctctgggcttagctaaagtaatcctctcacctctgcctctcaaaattgctgggattagaagtgtgagccactatgtctggcagctctttcagtctgtatgttaagctgcatggttatcaaaagaatgtgcctcagaaccgtctgaaaggtttataaaaccagattactgggccctgccttcagagtttctgctttaataggtctgggatgaggcctgataatttggatttctaacaagttcctagatgatgctgacactactggtcaggtgaccacactctgagaaccacagtgctaagggaacagttttatcacctcaagttactgaatgagcactttaagatcacaatatgtttaccctctaagatgagctgatataccacttacttataagtcagaaattcaaagccaaggacgcaggacctgatactctgtacagccagggtaattctgtggtactagaaataatcatgccaaggcctttttatggttactgtaacaacaggagtctctaaatccacatccttcacatggagttagttttgtaatccatctcccttgagttcaaggtaattgttacctcattttttcatagcctctttcagctttttcacctgatttagagagatttgtcaggttgcttctctacttgattggattcaggtagtctatttactgccccattccaaagctgactatagaccacagctgtaaggtcattccaataaaactttggaacagcattttctgtaaaccatgtaatgtattttctatattttgatcattattatcattattattattttttgagacggagttttgctctggtgcccatgctggagtgcagtgatgtgatctcagctcactacaacctctgcctcccaggttcaagagattctcctacctcagcctcctgagtagctgggattgcagatgggtgccaccacgcccggctaatttttgtatttttaggagagacagtgtctcaccatgttggccaggctggcctcgaactcctgaccccagatgatccacttgcctcctcaatcattgtttttatgaagaaatttttccttcctttttgtctgctttacattcaaacattttaaaatttcctcttttgaagttaaatctgggcacagcctaatataatctggttgcttgtgtttgttgtctgttctaggttcacttcttcaacagcttttttcatagacagctggtaaccaaaggatataatggagtaaaaagatggactaaaaaggtattctctttatttcttttttattccaaatttgaaacgcagatgataaaccactttgtgtggaaggataagtactttaatgccaatacgatgttaagtagaaacagactttttaatgtgacaagttttaaatttgtttcttttaaatcttattgtttgaaagaccttaattgcctactggtcccaattatagtggtagaacagtgggatgataaagaaggagctgccatcatttggtgttatctggtaggcttgtcagcagacagcagaagctttcaacaattttttgctggtgctgggcacggtgcctcgcacctgttgtcccagctacttgggatgctgagaccagaggatcacttgagcacaagcatttgaggccagcttgggcaacatagccagatcctgtctcttaaaatgttaactgatccatcaggagaaataacttttatatcacaatctattcataaaatcttatacatacatgtaattgaaataatttccaaaaaccatgtacctaatttactatgtatgatgtactctagtcagagagtggtaagtgctatttgctatggaaacatcagaacacagtatgagaatacaaggtaactgggatagggtagcaggaggaagatgggctagttcttttagataggcttgtcagcaaaggcctctttgaagagatcccatttcactgaaaactgtgaagatcagaggagcattcccagtagatggaagagtgaatgttaaaggccctgaagcagaagtgagtttggtatattggagtattacacacatgagatcagggaaggaggcagggatcaagtcatgtggcgccatataggccctggtaaagagtttggatcatgagggcaatttgaagacattagagagtttaggccaggtgcggtggctcacgcctgtaatcccagcactttgggaggctgaggtgggcggatcactgaaggtcaggagtttgagatcagcctggccaatgtggcgaaaccctatctctactgaaaatgcaaaaattagccgggctgtgatggtgggcgcctgtaaccccagctacttgggaggctgaggtgggagaatcgcttgaacatgggaggtggaggttgcagtgagccgagattgcactattgcactccagccttggtgacagagcgagactccatgtcaaaagaaaattaaataaaaaataaaaatgaagacattagagggtttaagcagcaggcaaggagtgtgtatgagtgtgtgtgtaaatgatagataggattgtccttagcaacattgattcattcattcatcatttatttattgatttattttttgagatggagtctttcaggcgctatcttcgctcactgcaacctctgcctcctgggttcaagcgattctcctgcttcagcctcctgtgcagctgggattacagtcacctgccaccgtacccggctaattcttgtatttttaatagagacgggatttcactatgttggccaggctggtctctaactcctgacctcaggcaggtgatctgcccgcctcagcctcccaaagtgttgggattacagggtaagccaccgtgcccggcattaaacatttattgagtacctgttatgtgcctatatggaaaaacttttttcctttgctgtcacaccacaacagtagtcagcacagaagacttctgtgaccaaagcaagcaagcaagcagttctgcagcgaccactggctggatgccctctaattcaattccgacctgtctacctggagacagtgccacgtcccatagtttgagggctcatgcctcaagagtgccccccacccacttcagacaccagttgcaagtccaggcttctgaaacttctgaccaacagacttcaagtgagggttcccatgccgccctccttgaatttgattaatttgccggagcggttcacagaattctgggaagttcttacctacatttagcagtttattatataggatattacaaaggattcagatgaagagatgcatgggaagagatgtaggggagtgggcacagggattctctaggacctccacaggcacatcaccctccaggaacctccacatatttagtatccagaagctctcccagtgcagtcagtttttatggaggcttcattacataggcgattgactaaaccagtgaccattggttaacctttagcttctcttctctccctggtggttggggggttgggtggggctgaaagtcacaatcctctaattctgccttgctcttatcctaaagccacctagcagctgccagccatcagttaatcatcaacatacaaaaagacatcactttgggcctgggtcatgtccccgtaatcccagcactttggaagtctgaggcaggcagatcacttgaggtcaggagttcaagatcagcctggccaacatggtggaaccctgtctctactgaaaatacaaaaattagctgggtatggtggcatgtgcctgtagtcccagctacttgggaggctgagacaggagaatcgtttgaacccaggaggtggaggttgctgtgagccgagattgcaccactgcactccagcctgggtgacagagcaagactttctaaaaaaaaagaaaaaaagacatcagaaattccaaggactttagggagttgtatgccaggaaatgaggtcaaagaccaaatttattattttacagtatcatagtgccagacattatagtaaatcaagaaataaagaggtaagtaaaacaatattagagacagtttttgctttcacaaagtctgcagtctagtggtggagacagcacctaccacagtttgtatttatatttttggtggtgtaattatttgtttagtgggtacaaaagaaaagtactacaggagtgtattggaatgcaggtttggttaacctagcctgagggtaagggaatgtttctcataggaagtaatatttaagcagaaatatcaaagatgaatacaagttaactaggtaaatggagaataggggtatgtgaaacataggcagaaggaataagtatctggtagaagaatgggaaaaggctagtgtagctgaaatgcagagagttaagaagacagtggcatgaagtgtacctgatccacagatcagggccttgaggtttgtattttggattttatcctaaatgtaataggaaaccattgaatggtttttagtgacattatccactttgtagtctttgttctaacagtactgaagaagatggatgggtatgggagcaaagttgatgtgggcagaacaggagaccatttcagattcatggtactttgaagtagaatgatagcaggagagatggaagatgagtgtgatgtaggaagtaaaattaacaggatttggtgataagttggttatggagatgaaggacaaggaagtgtgaaagatgacttccaagtatgtgacttgtatgactggacggcctatggttgtatttacattagaaaaatgtaggacaactagtagaggattgttcaaatttaaaatgtacagtcatataattggatgctacttaagcaggaaaagctgtgtagataatgaacgatgggccgggcacagtggctcacatcagtaatcccagcactttgaggggccgaggcaggcggatcacgaggtcaggagatagagaccatcctggctaacacggtgaaaccccatctctattaaaaatacaaaaaaattagccgggcgtggtgacggatgcctgtagtcccacttactcaggagactgaacccaggaggcggagcttgcagtgagccaagatcgcaccactgcactccagcctgggcgacagagagactccgtctcaaaaaaaaaaaaaaaagataatggaagatgcttatattccatttggggtgggaaaaattacaagcagtgtgggcaaaaaatatacattcatggaaaagtatctgaatgataaacatgagagtgaaagaataaagtcaaatatgtgagttgtttcattaaataataaactaaattattccttcctctagatcaggggtgtccaatcttttggcttccctgagcctcactggaagaagaagagttgtcttgggccacacataaaatacaccaacactaacaatagctgatgagctaaaacaaaaaaaattgcaaaaaagatctcataaaagaaagtctacaaatttgtgttcggctgcattcagagccgtcctgggctgcatgctgcccgtgggctgtggactggacaagcttgctgtagatcctctgagattgggttaagtaaaaaaaaaaaaaacccaggtttatgctgaatataagaagtatacataaaataatatgaaaaagaaaggttgaaaatgaagtgacatttaaagaggctgggcgctgtgtctcacatctgcagtctgaacactttgggaggcctaaaattactgtagatgggaggattgcttgagcccaagagtttcaaatcagcctaggcaaccaagcgagaccccgtttctataaaaaatttaaaaaacttagctggccatggtggcagcctgtggtcccagttatccagaaggctgcggtgggaggatcacttgagcctgggaggtcgaggctgcagtgaaccctgatcacgccactgcactcctgcctgggtgacagactgagaccttgtctcaatttaaaacaaataaaaaaggcaactacaggaaagttaaacaacctgttcctgaataactcctgggtaaataaagaaattaaggcagaaatcaagaagttctttgaaaccaatgagaacagagagacaatgtaccagaatctctgggacacagctaaagcagtgttaagagggaagtttatagcactaaatgcccacatcgaaaagctggaaagatctcagatcaacatcctgacatcacaattaaaagaactagagaagcggctgggcgtggtgactcatgcctgtaatcccagcactttgggaggctgaggcgggtagatcacctgaggtcaggagtttgagatgagcctgaccaacatggagaaaccccatctctactaaaaatacaaaattggctgggtgtggtggcacatgcctgtaatcccagctacttgggaggccgaggtaggagaatcacttgaacccgggaggtggaggttgtggtgagctgagattgcgccattgcactccagcctgggcaagaagagtgaaactctgtctcaaaacaaacaaacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggattttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacggataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctgaaactatttcataacaattgaaaaggaggaactcctccctagctcattttatgaggccggcatcatcctgataccaaaacctggcagagacacaaaaaaagaaaatttcaggccaatatccctgatgaacatcggtgcgaaaaattctcaataaaatgctggcaaaccaaatccagcagcacatcaaaaagcttatccaccatgatcaagttggcttcatccctgggatgcaaggctgattcaacatatgcaaatcagtaaacataatccgtcatataaacagaaccagtgacgaaaaccacatgattatttcagtagatgcagaaaagaccttcgataaaattcagcatcccttcatttaaaaactctcaataaactaggtattcatcaaacatatctcaataataagagctatttatgacaaacccatagccaatatcagtgggcaaaagctggaaacattccctttgaaaactggcacaagacaaggatgccctctcccatcacttctattcaacataatattggaagttctggccagggcaatcaggcaagagaaagaaatacagggtattcagatagaaagagaggaagtcaaattgtctcttgcagatggcatgattctatatttagaaaatgccatcgtctcagccccaaaaccccttacgttgataagaaactttagcaaagtctcaggatacaaaatcaatgtgcagaaatcacaagcattcctatacgccagcaatggacaagcagagagccaaatcatgaatgaacccccattcacaattgctacaaagagaataaaatacctaggaatacagtttataagggatgtgaaggacctcttcaaggagaactacaaaccactgctcaaggaagtaagagaggacacaaacaaatggaaaaatattccatcctcgtggataggaagaaccagtatcttgaaaatggccatactgcccaaagtaatctttttttttttttttttttttttttttttgagatggagtctcgctccattgcccaggctggaatgcagtggcatgatcgtggctcactgcaacctccacttcccgggttcaagcaattctcctgcctcagcctcccgagtaggtgggactacaggcatgcaccaccatgcccagctaattttttgtatttttagtagacacagggtttcgccgtgttagccaggatggtctcgatgtcctgacctcgtgatccgcctgcctcggccttccagagtgctgggattatagatgtgagccaccactcctggctgcccaaagtaattaatagatttaatgctattcccatcaaactaccattggcattcttcacagaattagaaaaaactactttaaaattcatatggaaacaaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaactatcatcagagtgaacaggcaacctatagaattggataaaatttttgcagtctacccacctgacaaagatctaatatccagaatctacaaggaacttaagcagatttacaagaaaaataaaccatcagaaagtgggcaaaggatatgaacagacacttcgcaaaagaagacatttatgtctgtagtctcagctactcgagaggctgagacaggagaattgcttgacctgggaagtggaagttgcagtgagccaagattgcgccactgcactccagcctgggcgacagagtgagactttgtctcaaaaaaaaaaaaaaaaggacatttatgtagccaaaaaacatatgaaaaaacctcatcagttgggcgcggtggctcacgcctgtaatcccagcactttgggaagctgaggcagttgtggtggtgggggcctgtaatcccagctactcgggaggctgaggcaggagaatcgcttgaacctgagaggcagaggttgcgtgagctgagattgtgccattgcactccagccttagcaacaagagcaagactccgtctcaaaaaaaaacaaaacaaaaacagctaatcactgatcattagagaaatgcaaatcaaaaccacaatgagataccatctcatgcgagtcagaaatgacaattattaaaaagtcaagaaacaatagaagctggcaaggctgtggagacataggaatgcttttacactgttggtgggaacgtaagttagttcaaccattgtggaagacagagtggcaattcctcaaggatctagaaccagaaatatcatttgacccagcagtcctattactgggtatatacccaaaggaatataaatcattctctatagagacatatgcgtgtgtatatttattgcagtactcatagcaaagacatggaaccaacccaaatgcctatcagtgatagactacataaagagaatgtggtacatacgcaccatggaatactatgcagccatttaaagaatgagatcatgtcctttgaagggacaaggatgaagctggaagccatcatcctcagcaaactaacagaggaacagaaaaccaaacactgcatgttctcactcataagtgggagttgtacaataagaacacatggacatagggaggggaacaacatacaccggggcctgtcagggggttgggggcaaagagagggagagcattaggacaaatacctaatgcatgcagggcttaagacctagatgacagcggggtgcggtggttcatgcctgtaatccagcctgggtgacagagcaagactctgtctcaattaaaaagaaaaaaacaaaactagatgacggattgataagtgcagcaaaccaccacggcacatgtatacctatgtaacaaacctgcctgttctgcacatgtatcccggaactttaaaattttttgaaaattcaagttttcattaaaagaaaaaataaaaggtactaggcagctgggcgtggtggtgtgtgcctgtagtctctgctactccggaggctgaggtgggaggattgcttgagcccaggagtttgagactgcggtgagcagtggtcacaccactgtaccccagcctgggtgacagaccttgcctctaaaaataataatttgtttgaaaattgtagaaatttaaaggtactagacaaattgaaacaaaaacagaaaggaatattaatcatattaatagcagttgaaatagaatttaaggtgagaagcaaattgtgtaattatcagatttcaatataaaggagatataatgaccaatctttatgcaccaaagcacacagttgctaaatatgtgtaatacaattaaaacagaaacaagaggaccttggtaaaatagtgatagtggcagacttttctcataagtggataaatctagtagacaataaagacatatacaaaaattacagtcaatataattgatttaatagatgtttatgctccttaagagaatatacatttattgctatggttcaggaatatttgtaaaaattgaacatgtacttagccacaaagaaaattattttttattagccgggcaaggtggcatttgggagcccgaggcaggtgaatcatggggtcaggagttcaagaccagcctggccaagatagtgaaacctcttttctactaaaaatccaagaaaattagctgggtgtggtggtgtgcgcctgtaatcccagctattcgggaggctgaggcagagaatttcttaaacccaggaggcggaggttgcagtgagctgagatcatgccactgcactccagcctgggtgacagagtgagactccatctcaaaaaaaaaaaacaaaaaaaactagtaagaccctgaactcagtagaagactcagtgatgaaaaggtttataagaaaggcttttttttttttttttttttttgatggagtgttgctcttttgcccaggctggagtgcagtggcacaatcttggcttgctgcaacctctgcctcctgggttcaagcgattctcctgcctcagcctcccaagtagctgggattacaggtacacaccaccacacctggctaatttttgtatttttagtagagacaggttttgccacattggctaggctggtctcgaactcctggcctcaagtgatctgcctgcctcagcctcccaaagtgctgggattacaggcatgagccactgtgcctggccaagaaaggctcttaaacatataaaaagttgcataacttcacagtaaaagaaaagcaaatgaaaaccacactgagtgacagataaatgcagtaagttaatcttgattggatcctggactggaagagatgcaatattttgggtaaattaggggaaattttagtatagactaatatattcaggggtcagtgatctttttctgaaagagccagataataaatactttggattttgcagaccttatggtctttgatttatctactgacctgttacagcacagaagcagatgtagataatacccaagtaatgagtgtggctgtgtttcaattaaacttaataaaaactggcagtgggccatacttggtcattcatgcattagatgatattagtaaactgatgttaaatatcttgt

SEQ ID NO: 1651 - DNA, 95856 bp, Homo sapiens
gcctcatcctatacaagataaaattgtggtaagaagacacattaggcttttgaagatgggtcttgaactttttggaaagccttcactacatgctggccagtgttaagttggtttagtatgccaaggactgcttaggcaaagaagcagatttttaggtacaaacctagagagcatttacaacagaggaaaatgggtacagtccccaggtctgcaggacaggaaacgtgggtcctgtgtgaacacataatcgggggagagcgctcattcactgagtactcgctatgccatcggattgaatcctccactagctcggtgaggtacatactatgcccatttaacagatgaggaaacagatggtcagagagctcagataagaagcccagggtctcaccatgtagaatctggatgcagggccaagttgtcttggaactggaatttggaacacctgacatgcttggttctttatttcctgctgtttcctgagggaactgacctgcccaagcaggaccaaaaggctaccccatgaagaaaagctctgctactggatcattgttctcatctctctctgggtctctgctcagtggaggcagaaaaggtgcttttccatttctattgcctgacttcctctccattcacatggtaagtgttgtctacatgcttgctgagagaacaactggaagatgagtgaatgtgtgtagactgtgtttcctaatgtgtgaaatgtgtactggtatctgagatgatttaagattgtgccacctttataaaaatagatccacctttattttagtggatcattaacatacattagaaaaaaatcattaacacagcctgggctttcacaaataatattgcttgaaatatggctgagtttaaaaacttgaattgattattaaaatacattaagtagacgacactcatgcatgacaactacaggaggtgttaataggaataattgaagttagggagctctacccaaggaggcaaattcatattaattcctaacatttattgagtacttggtaagtgccaaacactattctctgttttaccttatctgcttaaatcctctcaacaaccctgcgaagtatcttacctccatcttatagaggaggaaactgaggcagagagcaaggtctagctaagggtcgcaatcattagcatgagaatttgaactgaagcagttggactccagggatcaaacccccaccttgaacacaagataaagctggagttagggggtaacaacgtggagcctctggagagctcaagggtttttgattcaacagtccaaaatgaggaggcagatgcagttagcactggagaggagggagttacccatgagggaacccagggaggaaaagttattcctcaaatgcacatgggctccgggctgcagcccaagagcttcagccaaaacaggagccaaggtcttctaacccctctcccttcttccacgctttgttttgctggggttattttagttcttgctactgcaaggtcaggaacattcccaactggcaattggtctccaagtgccctcagcatggactcagtcccttgcaccagtcagcatcctttgaatgcagtctatatttgtgcccaggagtttctatttgtggtggctgtttttgttttaagctctctatgcaaatgacacactaatggtctggtcctaagggaaattctgtcttcaggtgacagagaacttttcatttaaacaagtgtatctatcctttttcactaaagccactacagtcggcatctgctcattttgttcattttcctcctgaaataggttagctaatcattgcttatcacatttccaactagtttctttttttttacttgaataactatagctccaccctctatgggtttggggccatgcctttcaggcctactttgcaaactgtgctgataaaagacaagattgtgaacttgcccacattacatgggctgccaatcagcctcacatggtgtaatttaattctaatacgcctcctgatctttggtgcatttaaaaataacttgttaatagtcttcctattctaattaagctaaaattgcacacactgtgaaatgcttgctctcttgctctctcatgctctctctctctctctacacacacacacacacacacacacacacacacacacacaattgatccttaaaaatcatttctgtaaactgcctgtgtagcacagtgcttctgaaattctcctgtgtcttcccctgacctatgcccacaatgatagacaatagaataaaataactgtggccctggtaccctaggtccattaaaatattcataataaattgtctaaacattgataacaaagtggttaaaattggaacctctagagccaaatctcctgggttcaaatcccagctctgccactaactgtaactttgtgtaagtcttttaactgtttttatttcctggtttcttaatgtgtagaaggaggataatgatgagatctacttgggaaagttgtaagagttaaatgaaatactggttttttaaatggttagaacagagactgatgcacataagtattcattattataattcagtttttgcattctttaaagtgaagctgtgttgttgcagtattttaaggatatattgttccccaaatttttgggtaaaattgactgttaaggaagatgagtcatgtttaaactgtaattgtgagtagaccaccctttatccttgaagggctttctcaaccaggtgaatggcatggctgtggtgggaaatacagggccctgtgagacaggaaatctagggggttgtctagctccattaccatcctcttcttttatggattcagtgtcttgttcttttgttccatgtgagaatcatccctgccctgcctacgttataaagctggagaaaaatgaaataagtaaaaacacatggaaaacgtactaaaatattaatgcaaggatgcaaggtataatctttgctggaacattagttcctcatttattagtaacattacaggcatttgaaattatgtactttatatgggacctatattttaaatatatgctaatcatcctagaagccctacaaggtaggtgttacttttttccattttaccattaaggaaattatccaggtttacacaacttgaacccaggtctctgtcagtaaaaaactgtctactcttccaaaccattttatctatccatatttatttcctccatcaaacattagttgaatgcaatgtggtgtatcacccaaggtcggctggcatcttgaaaacaataactatgtgttactcagcatcttagcacctagcaaagagtggagaatataacagtctttcaattaagttttgtcgaagaaagaaatgaaggctcttggtctttagaaattcacaaatcagctgaggagacagacatactaaccaacagcatatgatcagcatgttctaattggtactgtctctggaataaaacagctggcagcaaaaaatgtctgacttttgcagagaaactcctaatatgagtttgactgctgtcccacatctacctatgtggtcgtagtgctgtagtcactgttgttaccctaagaggacagccttgttcctccaggtctcttacaactctcttttaaggagctcgtattagatccctagagctgctgtaatgcattgcccaaatcttgtgacttaaaccaacagaaatttattatctcatagttctggaggctagaagcctgaaatgaaggtgtctgcaggcttcactctctctgaaatttttatgagaacatttttcatgtgatttagagcccacctgggtaatccaggatgatatcatctcaagattcctaacttaattacacctgtaaaatccatttttccaaataaggtcatattcacaagttctgaagactaaggcatggacagatctcattggaaaccatcattcaacccactgcaaagctttagccaattcccagctatgaattcttccaagatgaaaggataccaagctcaagactctcccttgttcatttgaggccttcccaaagatgactgacattttcacaaattttatttggtttcatttcctatcttaacgaaaacaatgataatttcctatcttaatgaaaaaaatgataatgtttatactgtatgataattaaaacatcatgtaaagattactctttatctaaatgtttgcacatactctttgaacatccatcatttttccagcagttatgattttttcttcccaggaatatgggaatgaagtgaaattgacaacttttcccccacgcattgtatcctcttttaatgccaccccctgtgtttaacagcctctgacacaatgtaggagcaatccatggtactcaaagaatattatggaatttaacaacaagtatatatatttgtcttgatccagtgtcttatctgattaccttgggccacaggaataccctaggtgagaagggaaagttgggttctagcccaagtcctgttactaagtctcttagctccatgacccttggatattctagttattattactacaaaacttagcggcttaaagtaatctttttattttacataattttatgggtcagaaatttgggaaaggcttaggctggaaagttttcacttggagtttcttctaccattgcagtcatatgtcaactgggacttaaatcatctgatagctcagctaggctagatatccaagatgcctcactctggtggttagtaccagtagttgactgggatctcagttggggctgtcatctaggacaacggcacatggcttttccaagtggcagtgttaagacaatacttttaatatgacatctggcttcctctagggtgagtgtagaacctgtggaaactacacgggtatttatgacatagccttggaaatcatacaagatcacttctcccatactcgattgagccaagcagttgcaagtcacccaaattcaaagcaatgggacgtagctccccacctctcaatgggagatgtgacaaagaatttgggagcaatattttaaaaccaccacaggtactttatactatgtgagtcttgctctcctctataaaatgggactacattgtctctaagactcctctagggcttaaagtctatggggcacttccctttaataatcttaatttatagatacttacattagtatttgtattccaattcttttctatcataaaataaccgtagtacatagaatttttaaaaatagaaaaacaggcttagtttcaatgcctaaatctttatgtatttccatatttcgagttgttttctgcgtgtttgtttgtttgtggtgcttgtgtgtctgtgtgtgtgagtgtggtgaacctaccagtacatcattttggcatcttttctcagaattaaacaagccaggaagacattctgacagtttgtttttaaagaccatcagttgccattataactaaacatactatacaacagtaacatttaatatcccaattaaattgtagtagttgttgacctcagattacaaactcaggtgggccagaaatgtcttattttacaataaatctgttttaattttgattctgaacccctgtcctgctgagctggtaggaaatatagcccttcatttttgagacaaccttccccactaactcctgaggttatatcattcatccaggtctcacacagttggaacaaaggggagggggctgaagggttttggttctcaattatccatgaaaccaaattcaccctgaaatgaccattatccttatttgctgggcttgttcaggtctgcctctcttatggttcgttgccttgcagggagtttgtgattattctccaggaaacagaatatctcaggtctagacttgctttttggtgcaccacaagcaatttccttatatcctccatgtcctcagggtcctgccatggaacagtaggcaggtgccctctgctccagagatccccacaactctttctccctcaggtcctacagattccatatcctctgccttttgccttacccaggctctattcctgctcgtttcttagtagtttttgatagcctaccaaaatcattagcaaccaaataactgcttcacttcatcctgaaattttccctggagaaggaaatatttgcgttccatctttctactgcttcagagaaaagaataaccaaatgactatttttccacaataagagtgaatgttcacatcctgctacaaaagaatacataaggctaatttatatgcattgcatattctccaatatataaagggaatcgcacttccatcagatagttttttgagtctgtgtttaactgcttcctaaatcttctgggtctaacaggagaacagcgtctttcatggctgatgacactgaagaagtgccaaagaaacagcaaaatggcagatttagtgtttattgttgggataagataatacaggttcataatccctatgtgctgtttcacattcaaaagctcagaaaaatcaaaataacttctagctcattaggcttctaaacctgacctgaactaatgtgaggctacttttaagtctttatttaccacacttacggtgcatatttttatgttatataccagaaatattagtatgactgattatgggagtgttacctacttcgtgctgcagggtatcacatgttgggactcagaaaatgataccctgaaatatactgctttgaacttccaactgagaggacctgaggagcagcaaatgctgagttccttatttgactaagagaatttccttcagaaggcattaaattgtcttgccccaccccacccttcatccccataatttcatcaaacagatgagactaactcataggaaagaagattgaagctgactccacacttggagctcatacaaactttttcccaggctattgtctgttcttcaagcccattcacctcccctaaaaatcatgtattcttcctcaaaaattgtctattatcttccacttccctttcccccatgaaaagtgttgaggcttattctgagccaatatgagtgaccatggcctgagaacccaatatgagtgaccatggcctgagaaccatctcaagagctccttcaacagttgtgactgagcttgtcaggttgcagtttggttttatatattctagggagacaggaattataggtaaaatcataaatctatatatagaaggtatacattggttcagcctaaaggggtgggatatcttgaaggcagggtggaggggatgcttacagatcataggtaaattcaaagattttctgattggcagttggttgaaagagttaagttttgtctaaagacttgaagtcagtagaaacaaaaatgcttgagtaaagataaggggggttgtgagggccaaggtttttggtatgtagatgaagcttcatagatcacagtcttcagagagaatagaagataaatgtctcttttcagactttaaaggtatcagactctcagttaatctctcctagatccaagaaaagcctagaaagagaaggcctgactccattaatggagattctctacagatgcaaatttcccccacaaaagatggctttgcagagccatttcaaaacatgttaaagaaaaataaagtaaaatctgtttatttccttcagggtctgctatctgtcatgtgccatgacatgctataccagtcaggttggaattggtgtcttattgccatagtctgtttactcagtcttatgatctctattttaatgttaatgctggtcagttgcgcctaaactgcaaagggtgggagtatgatgaggcatatcagacctccattcccatcatagctgggaattcagtttttcaggtttctctgggttctccctgaactagagagggtctgtttaaagctgcatttgcaaacattatgacagtgagacaaatctagcatggctgattccaacttgcttctagcctcacatgctggctgtttttacccattcttggctataggccaagctaaccatgaaaggggactgaattctgctaagatctactttctgtagtccactactgctcaggagtcacgtggctggaggtcacaagatttgtgacttattgctcctttagataacatcactattgtagaaactaaattggccttttgagatgttttttagacttttgtgtcctggcaaccactgaccccacccagactcaggactcaactggtcctgtggcccttcacccagagtgcccctccagcacacaaggactattttccatgcccctgtgattgcatccccagctaatcagcagcacccattcattagtcccctgtccaccaaactatctttgaaaaactaacctctgagcctttagtgaggctggtatgagtgacaactgcagttctcctgtgtggtctgcctcatgtcagttaaactatttctttactgcaataccacaatctcagtgaattaattttgtccatgtaatgggcaggaagaacccaccaggcgattacatgtttagttagctgagggggcttaggattttatttttggtttataagaggggatttaagcttcaatcatctgaattgtctttgagttttcatactttttgtgactctgtgcactttcatcttaatacatttgtatgccttttctcctgttaatctgtctattatcagtttatttcagccgactcaattatcaaaccttcagaagagaagtgtaagcttccctgcacacataatatgtaccatattatcttttggaaagttctccaaaattctagctttccaaacctatcttattctagggatttgagataaggcttgggatatatatatatatatatatatatgaattagaaagtttctttttcatggtatttcttcatgtgcccattacagggacagaaaagataatttttcctctacccttgtaaattctcagctggggcctcaatataaaaagacagattaacaaaagaaaaacaaatagaagtttattaacatgtatacagtgactttttctgtaacctctgcctccccccctcccaccatgtttatagacccctgcatttaaaccatctgggacttcaggttttaaacacgagctggctgaatcttcttgcttggtaccctgcaataaatgtatacatgggagacacccagggacaaatgaggaactctcaaagagatagtttagaattcaagcataaatactatcttcagctaaagacaaaacagagaatggtgtcagggaggacgaggtaactaggaaaagtacagtaaagaagagtaagttttgtaatgcagatgtaagtcaataccttccccactgctaagagcctctagtgatttacccatctttctctttcttatacagagagggagacacacttaaaaaattgagatttactttataaatgcaaatttcccatagaaaagggtttacttctcctttattttcagagcttctcctgtgtctgctgtttctcaaaataattctgctaaagaggcatattttggggtgtcatattctggtctcctatatcattcacgctaaatcatggggcaggatgattttccgttaaagctgaataccagggaaggctttttaaaatttcaaatgcttgtgcttctgaacatcaagaggcaatctgtgaagagattcaaagcaagaaagaagacaggaaacataagaacaaagcttcttgtttccccatcaccaagtctagttaaaattttccagttgaagggagaccaaggaactaagatgagataagatgttcatggggctgagggacaatgtgctgcagacttgaaggaaccatgcagaatgaaggtaagtcatcatccagggaacagccagcccccactggagtggcactttatactgtcagcccatgggaacaccacggatactaagtcagaaactctaaaacttctggatccattcaagtgagaatcatgtcgcttgtgccaaagaatgacatcaatagtctttcatactagcaactggtaagaagcgcccatccatagcagcctactgcctacttaatgttaatcagtactggctccagtggcccaagataattttctcaggccttgactgttatgaattaacctaactcaattttgccagtcaaaattatcagattcatttggttatcagtagtttcaaatgcttagaagcagactaaggatacaagactcctcccaaaaacctccccagcaggcttcactgaaaacaatctcagattgcaaagaaaggagtcacacaactgagacagagcagggacccctcttaaaggcctgcagcccacccctcaccaccaaagcgtgataataagggaatattttgacttcctttaagggaaattccatacacctagttagccctgggaagtaaatgagcgatttgataagcaagaagacaaaagtagcttaaaacaatagctaaagcagttagcatcacaagatgttttgttccctatagaaattaaagataacattttaacctctcttcctgagttggtttacagaaatccaaactcccaccaaacggatccattggcacatagaactcagataaggggcaattgaggactgaactccgatcaccattcttcgttctaaatttcttcccgagggaggcagttaaacccatgagctaaagctaacattcttttctgctgatcccaaattttagacaaagctttgcttcttaaccaatcacaattcagaaagtctttgaatctacctatgacctagaggccctgcttcaagatgtcccacatttttagtcaaaccaatgtatagcctcaatgtattgatttatgactttttctgtaacctctgcctccccatctttataaactcctacctttaaaccatctcagagttcaggtcttaaacatgagctgcctgaatcttcttgctcagtaccctacaataaatacctcattttctctcatctccatcccagtgtcactctttggctttgctgcactggattagcagaccccggtttggttttgttgggtacaggcccccaaatctggccataaactggccccaaaactggccataaacaaaatctctgcagcactgtgatatgctcgtgatggccttgacgcccatgctggaaggttgtcggtttactggaataaaggtaaggaacacgtggcccacccagggaggaaaaccgcttaaggcgttcttaaaccacaaacaatagcatgagtgatctgtgccttaaggacatgttcatgctgcaggtaactagccagagcccatccttttattcagcccatccctttatttcccataaggaatacctttagtaaatcttattatgactggcttgctgtcaataaatatgtgggtaaatctctgttcggggctctcagctccgaaggctgtgagagtccctgatttcccactcgacactctatatttctgtgtgtgtgtctttaattcctgtagcattgctgggttagggcctccccaattgagctggtcttggcaggtttgataatacaacctttaccacaacctcaaggaagttccaagtctctctctttaggtaccatcaccagacctcacacctgagacaagagcaacaatattctaaagttaggaggcagcaactttacagttggtgttcaacaaccagaatttagtaaattagtacctggacattgtttcagaaacaagcttcaaatgccattgtaaaagatctggatgtctgagctagctggattctattcacctgaagatggaagggatcttcacaatatttttagtccatccacatattgctatagtttggatttttgtcccccaaaccttatgataaaatttgatccccaatgtcagaggtggggcctaatggaagtgtttggatgatgggggcagacctgtcattaatggcttggtgccatcttcatgataatgagtgatttattactctattagttccagtagggagctggttgtttattttaaaaaaagggatggaaatgcccctctcacttgcttcctctcttaccttgtgatctctgcacatgccagcttgccttcaccttctgccatgggtagaagtagcctgaggcttcacaagaagcaaatactggcactatccttcttgtacagcctgcagaactgtgagccaaataaacctcttttctttataaattacccattctcaggtactcctttataacaacactaacgtggactaagacatacaccttgaacaccagtaatttcaacaatgagcacttatttgcatatccatcatgataattgacaaaacctccactattgatatataaaggtaggtgaaatgcttgtagttacagtctctgaagtgtgacttttaatatactaactcaccatccatagagtaatttttgagattgggcagccatgcatcctagtaatgtgcattaaagccatcatacacacacatatatatcaaatgcatgtgctatactatttgaaagtaagttatagactataatttattaactgaggtcctgtgtgggtaacctgcttttcagtttcccagagcactcagaagcccttcaagttagagggtggagcactggatatctagaaggataatggtgatgatatttaggtgaaatcttcccaggtcctcaaacttcacagttgaacatgttgggaactgaatgcaatcagaagaaaatctcctccaaaaccaggaaagaagtatattatcttccattctttctggtcagggaacagaccctacatttgggacagagctcgatttgttggaatattttttcactatagctcccctatggactacgctgagtcatgctttctgcaacaaatgtctccattgttggcacaatggtccaagaaaaagctgttaatgtggccataccttgtggttttgttttatgagacacgtaatcgtgttaatttgttttatgagacaggtaattgtgttaatatacagatattgtgttagaaaattaaaccattcatatacaagtattgtaagaaattaaactatttatgttatatattttcactaattgatgttaaatgtggtttcttaaaatgttaatatgaaattaataacttaaatatagaacattcaaaattttataaggcaacaatatagaagtgattaagtaaaaagattatatgtcttacatatgcatctgttggggctcagaaaatgatatcccccaaattaaagtatcagaagcagtctcagaatcaaagtttctctctgaccttctgccttcctatctctcagcctcattctcttccaagacaaatcatagaaaccagaatctcttttccccaaagtcagctatgaagtttaaaattgttactctaactctccccacccacttccttccatgtaggaaatggccataaagaaggtgtttcatctaccttgtttgattatgagtcataacacccctattccagaattctgccctatgacagaaggaaatgaatttcctccaatcagtctattactattagatcatacattttattggccaatcacatttctactcagctgtccctgcttcacagaagctaaatataaaataagatagttttccctgtgtattagtcaggattctccagaggaacagaactaataggatatatgtacatgggaaagggagtttattaatgagaattgactcacaccatcacaaggtgaagtctcatgataggtcatctgcaagctgaggagaaagaaagccagtagtggcttagtccaagtcccaaagcctaaacagtagggaagtcgacatgacaatgcaaccttcagtctgtggccgaaggcctgagagcccctggcaaaccactggtgtaagtccaaaggccaaagaacctggagactgatgttcaagggtaggaagcatccagcacaggagaaaaatgaaagctggaagactcagcaagccagcttattccactctcttccacctgctttttctagccacactggcggccagttggatggtgcccacctacataaagggtgggtcttcctctcctagtccactaattcaaatgttaatctcctctggcaacaccctcacagacaaacccagaaacaatactttgcgtccttcaatccaatcaagctgacacttaatattaaccattataccctatatcatttggtcatttaacctggagcctcctgtgtcatgtaaaacttagattaaataaatctgttatgcttttctcttgttaacttgtcctttgtaataggggtgttggctattacttttaacatcctcaggaaatgcatcacacctttctgttcctacatatctatgcttgttattttatcgtttctgtatttctgtgtgctagattgcttcccatttccctttttccaccatcgtgaataatgctgcaattaatattttcatataagtttgctatgttttatttttccttaagatatactataagagattatgagtatttttatgatacttacggtctctggccaaattatttctcaaaagtgttgtatccattttgattcccaccaacaacacgtaagacaagacatatatttcacagaacattcactagctttacatattagcatttttaaattgtaatagtccacaattatgcctcactaatgttattatttgtatctcttttattcatagaaggttgagttttttcatatacttgtttagaaattatatttctgggctgggaattatatgtaatttcctgtaggagagaacaggtagtaccttattgtcacccattgcaagattactggctaagatccctatagcaaaaaagcagattaacaagagaaaagcataacatttttatttagtataagttttacatgacacaagagccttcacaaatgaagacgtaaaaacccacagaaatctatgtatttttgtagaaagttgtgcagaagcgtggctggaggacaaaggagtgtgatctaatggtaataaacaggggagaactcagccagacctgtttgtttagagtcttactggcttcccggtatagggcagggcccctctggaataaaagtcttatgtcctactttcaagggaggtagtgtagggaattcttttacggcctgcttcagaggagaaaggcaagagaagatcagcgaggaccttcctgtttctgcggagcgtttttgtcaatttccttcagcttaaaacactcatcatgccaaggtgacatattgccaatgggtattgtgttctgagccctgacaatcctttatatatttgtctatgacactgaagtgattttatgaattataatatttgccagaaataatttcccactgtataggggaaaaatttattttacccatcactagcttcactgctgaagtctctgtaacaacagacagattgacaagaaaaacgcatgcaaatttattcacttataaattttttgtgacatgggagtcttcagaaaggaggacctaaagaaacagggaaacctatgtattttcatgcttaagtttgacgaagagtggacagttctgcaaatgtatgactgcacaaagaagacataatcttacggtaataaactgcggggaacaaagcaaggcctgtttgttcagattcttctctctccctgtgtcttcagagataaggatgttccttcctctgggcataggaagggtacctctctgagggtcttacgacccacttcaggggagaagggcgagcgaaagttgagaggggccttcctggttcttctgttttctcaaatgtcaaggtgacatattttgagggtagcatgtattaaaccctatcaccagactttcatttgctttttaattttcttaatgtgtacttaaaacatttaaactgaaaaatattcgtggagtataatcgctcactctatttccttatgaattctcctgttgcattcatatttagaagaaaagtgtctgtccaaagatccagtaaacatccacctctattttcttaaagattttctatggcattattttaaaacaattaattgcttattctctctagaatttattcaggtgcatagtgtgggcttgatggaagattatttatgttttctaattgctaaacagatgcccccaacatcatttaatgtggagtaagaatgaggaagtttcatttgttgtcaatttgtgctacttccttaaagatgcagtacatttgtccttgcaatggaaacttcttctggactattttgctccataattcagatttcagtacaagtctgctgtagataatattacttctaattaatgtttgtatattttaattccagaacaacagaaaaattatggctgttaatgtttttgtgtttgtttttcttatgcttcttttttatctaatcataaattattttattagaaaaaaattaaaaagtcatcacatactcaggcctatagcatgtattcagagttaataaaggtattttgtcatgtttgattcagaacttagcctttcatttgaaaagtaacaaaacattacaaatacacgaacatctaagtaactgtctttacttcctagtcctgtctctattgaccctccaagagtccagttctctttggcttaaatgtggatctttcctatcgatatatgtgtctaaaatctagagtgttacttcctgtacatgttctgtttaatttatgtaaatggcattttgtatatattgctctacaacttttttaaaatttaagattacacttttgagagctatctatgttgatcaatatcagtctaatttattcattttaactgctgtgtagcgttatcacacgaatataacaaaatttctttacttgccttactcaaagacattgggttatttccaatgctttttataattacaaagtgctgagtagacagacttgatctattttactagaagaggaactatcaaggttaattaactgaaacaaaacaatttagattataaaattcactgaaaagtaaagattgaacataattagtgaagaaacagatagtataaagagtagaagacagtgtaattgtaacctcaaaaagggagatacatctgtcagtttaagctctaacaaaatatgtctagaatctgtatgctgaaagctataataaactaatgaaaaaagaaagataaacataaaagaaatgctaaactctaatcatatatctctagcaagaatattctaaaatttatgtagagatgcaaaggaaatagactagcccaaacaattctgaaaaagaaataagttggagggttcatactatctgatttttaaaaaatacctatacagttacagtcctctgaataaggaacccagaaatagactacacaaatacagtaacttattttttaataattttcagagaaatctaaataaaagaaatggaaaaaaaatctcttaccaatccataaaatctctcccttcacaaaggtagaagagaggccgggtgcagtggctcacacttgtaatctcagcacattgggaggccaaggtgggcagatcacttgaggcaggagtttgagaccagcctggccaacatggagaaatccgatctctactaaaaatacaaaaattaactaggtttggtggcgcatgcctgtaaccccagctacttgggaagctgaggcatgagaataacttgaacccaggaggtggaggttgcagtgagctaagatcgtgccactgcactcatgcctgggcaacagagtgagtgagactccatctcaaatgaaacaaaacaaaaaacaaaggtagaagaaaaaaaaacaattttattattccataagcattaaactataatgtaaggagcatcacatgcaactggctaaggggattgtaaaaatggaaagaaatcacaccattttgtatagcaaagcagatgcaatccattacatacatgtgaattgtctttatcaaaaataataataaaacttcttatatttttgtgaaaagcaggaagttacactaggagtcaagcacgtaggctgaaactcccacaggaacaggaagacagagctcatcttcctcgatgtttgcgtttcaaaaagaaggtccaaacatccccaagaaaaaaaaataactgaaatgaaaaactagcaagagactcatttagcttttaaagagatttaaatacgtctcaacctgacacataaaacatttgcaatctattttctaaaggaagtgcctatcagaaagaaagggggaaatgtttcctctctcttttggcatgagaaaaattacatttttaggatttatatttatactttatacaatatacaaagacagctgagtggataaagaatagtcctttctaaatagtggaaaaattacgtgtcatatacaaaatatatgaacctcaacatataccacacaccttatacaaaaatgaactcaaatggtttataaaaataaatgaaaaagtgtaaaattataaaacttatagaagaaaatacaggagaaaatccatgtgattttgaggttagaaatgagttttttttaagatatgataccaaaatagaaaattaatacatttcagttgattaaaatttaaactttcattttgtgaaagacactaataagaagacaaaaggtaaatcacaggttgggaggaaatatttgtaaatcatataccaatagaggacttttatccagaatatataaagaacatttaaagcttaatatgaagaaaacaaaaacattaaaaaaaggggcaaaaaactgaacaagaactttatcaaataaaatatacaatggtaaataagtatattaaaagcatctcaacattatcagtcattacagaaatgcaaattaaaactacaagaaggcataggattctgcaaagatggtggagtatgtagcatcaaaatctgactcctcaaaagtcaacaattgcactggcagaatttgtctgatgtaactattttggaattctgaagtctattgaaggcttgcaactttcaagggaaagcttagatggcaaattgctgttattttagtcaatttcagctcttaaaatagtagtagctacctatgctctataccaggggtccctaacccctgggccacagacctgtactggtccatggcctgttaggaactgggcagcacagcaggaggtgagtgacaggtgagcaagcattaccgcctgagctccgcctcctgtcatgtcagtggcggcattagattctcacaggagcatgaaccctattgtgaactgtacatgtgagtgatcttgctatcattctccttatgagaatctaactcatgcctgatgatctgaggtggaagagttacatcctgaaactatccccaataccaggtccgtggaaaaattgtctttcacaaaactggttcctcatgccaaaatggttgggaaaccctgctttacacctcagccacatggcaggctattttgcacatgttcctggagcaacttgcacacagcttgtaggacccagggtggacaaaattaattctactctttaaatagtggagatccgtgcttagttgctgattgccacttctgatcacaggggtgcagacacagaggtgatagcattgttgttgtaccttccccaattgtgcaagcctcttctccagctgaagtgacttccaggagatgtataaagctggtgtcccctccccttcatttttatttttttccttttttggaaaccagatattaaagactatggcattcaaaagcaaacacatatatgaaagaaattagaaaatcactatatatgcccagggaaacacagaagttcagaaaagatctgagaagactttaagttcacattggaggttgacctttggcaaagatacagtctatagcaaaaatgacaactaaaaaaaccataataacaaaaatacttaaatcccagggaaagaagaaaatctgatttccagagttagcatgttattacttacaaatggccaattttcaaccacaacaaaaaattataagacaaataaagaaataggaaataacggctcactcaaagaaaaaaaaccacagtaaaaaccatacctcaaaatggatctactagacaaagactttaaaacaactatgttaaagatattcaaagaactaaaggacgatgtgtagaaagtcaacaaaatgttctatgaacaaaatggaaatagcaataaagacatgtaaaacctaaaaagaaagaaacaaacaaaaaccaaaattctggagccaaaagtttcaataactgaaatgagaaatccattacagatactcaaaggtttgagcaagcagaagaaagaatcagcgaacttgaagataagacaatggaaattattaacacaagaaatagaaagaaaaaagattaaagaaaagtgaactggcttttgggacaccatcaagtgaatcaatgtacacattgtgaaagtcctagaaggagaagagagagaaaaatagactatttaaagaaataatgagttaaaactttctaaatttgatcaatgatataaatataaacctctaaggtgagggcatgtcaaaaggacacagaagtcaatctgtgaaagctcccagtgatcaaacctggaaccacctgagcataaaatgaatatcctcgagtccacactgatataagtacaaaattaaatacataaataactatggagaaatgcatgtttttcttacaaaataattccaattgataaatgtaaaagagatgacagaaatacaaagtggggccaggtgcggtggctgatgcctgtaatcccagcgctttgggaggccgaggcgggtggatcatgaggtcaggacttcaagaccagcctggccaacatggtgaaaccccgtctctactaaaaatacaaaaattatctgggcatggtggtgtgtgcctgtaatcccagctactcagggggctgaggcaggagaattgcttgaactgggacctgggaggaggaggttgccataagccgagatcctgccactgcactccagcctgggctacagagtgagattccgtctcaaaaaacaaacaaacaaaagttagcagtagaacaccacaggaataattgcagctggcagcatccactgatgactgcaaaaattagtgagcaaaactgtaaggagaaataggatacttgcatagccttaaaaatctcccctaaaatatttattaattattgttagtggttttactttatgtctacagattcttttatactcctcactccaaaaatggagcttaattctcctccataagtaactcacttataaataatagtgcatgaaaagggaaaaacagtaaacttcacaatggagaaacctgccaggtactaccttaaccaagtgatcaacattaacatcatcagtaataagaccagacacaacccagacatcttagtctaaggctaattttgtcctactattgaggcaaggctttttaaagtattctacccaatgcttttctaagtattctacccaatgtcttgtaaatcatgaggtttttcagcctggctagtagaaggaggcaatattacaggccctgtatgagaactggacactgtttccttaaaccttctaagggaattctttcttcagcctcaggtagttttcttacatgcatgtgctgatcagtactctgttgaagactcaagggagactctctgcggatcagaattttctctcaatgtagctcttttctcttcagtaatctgtcccaatcctctagctacctggtctcccagtgtttcaaatccgtctctttaactcaaagagtcttctgagatccatcttggcttctcttcctgtgccacacttaaaaaacaaacaaaaaacacctctcattcattaagctggagcaatcattgggttcacctcattagcttcctatttctcagggatcactgtccttcattacctgatgtccaatgtcttaaaaacttatttaatatattttgccctgttgttttgttgtttcatgtgaaagaataaatttggttcctgctactccatcttgtagaaatggaacactttctttaaatactttaattctagcttttacatctattattttatcacccaatccttttatctctctgttcatttattttacttctgacagttttctcaagtcaatcttgtgcttaattcatctaaacatcaaattattttatatttattcatttattatctatatatccaacaatcattgctaatatctgctgtttccagtgcagagttgaattacagaagcacaaaattatatgcaggatacataagtgattgaattaataaaataatacttctcaggattatttaagaaagaatatttgggtaaacgtaaagcactataacatgtttaaaaaataactgtttatattttctacccacaactaaatcttaccccctttaatctctctctctctttttctgactctgtgaggtcagtttattactcccttttctcccaatatgctatggatgttttccatttctttcctggtgattcaggtttgtcctttaagttcgtgagaagcccacagcagcttaaattggttgagtttgatgctctacttcaccactgtaacttactcaggtcaactctctaccaggaagcaaactgatatctaatctttgtgaaacctaaaatatgcttgactcttgtgatccggaataactgtggctaagtattttttcctcgttttcagcatttaatggctgttttggtgaaaaagagagaaaagggatttcatgggcaattactcttcaaattaagaaaaatcatctgtaagcaatgaaactcacaatggggtccaaagtcacccaaacatgcagctagtgctcttaattcagcaaactctttgaagaatattcattggattttttattttgaagataagaaccaaaggcaacccatttagagcatcaggcctaagactttaagacatttagttatgattacagaaagcagcatcacagaacattcagcaaccacgggatttgagagctgcagcagcagcagcataaatgccaaccattgacttctaattaccaggcgcttcttagaagacggcagttggcacagtggctggtgatccagtttttcttcggttttcatatgcagtagtaagttatgattgtcagtgtgtttcagttttctgaattctatcatatctctttttggaagttacttgctcatccaaattcattcaccacttgcctacttaactaagcttccttccaaatttctctggtaatgacaatccttttttccacttacccatagtcaaagacttgcatcaatattccacaaatgcccttactcataatagtgcacccttactattggtcctttagaatagtgtgatccacacacatcacgtatattaaactgctgacctgtgaaggggaagcttaaacactggctgtagtgttcaggtcaatgaccttggtaccaatttgatctctttcggaagttatgtatttgtagctctaccaggctctgttaactcttgctttactctccatctttggaaattggattttattgtttaggcttggcctatgcagcattcaatctactcttttcccaagatgtaaagtatagtggtggtcactgcatttcagttaaaaatcttatacttcctttttggctttggagaacccagacctgctgccaacacttgacaaacatcctgaccaagtcagccccatccctaaaagtaccatgccttcaacctataatccagtccctgatctgtaactacatacatacaccataggccaggagaagagctgttgtgtgaaacctatatctattaagatgtttccatgatcttaaaactcagaccaatagagattggaaacactatgctagagcataaatatgcaggattaatcacgtgactgttatttcactgatttagctagctatagtaggggtggaacaggcctgggtgccacacaattagtttattcataatctctaggatctgttcttcacccttgtttgttcacattaggagaagagatgcagaaattctcacctataccttattcagctacaactacatatggatatcctgagcttgcagagagtaaagatttttaacatttcctcacaatttgcataccagattagggcgatatgcaaaccagcaagtcactataacatgaatgtaaaagccccccagaagccattcaggttggattgcatagctctgccctcaaagatgtgagaataccaaaactgattcacaggctccagacaacggacagtaaaacactgatttggggatattcgtcccagaatgagaaaattctctcctatagatccaaattagaggccttagaggggtttttgaacacttgatctagtcattcaactaaaaattcaacccacatgttaacttagatatgagatgaaagacatatttttctatttagcatgggttcttaaatgcgtcccaagagaggggagttgagataatgacatttgctcaagcatccattgctcatccttttctgtacccagcccatcagcagaaaggaaccacacctgcagagagaacagctgtgtttccattacggtttaacaatcttctcatcccttcatttccggcagagcatgacttacccagagaaacttcaaagctttcaaataacagaataaaaattgtttaggactcaccatccacatgaaccatagtttgaactatttgtgtactacattgttatcagttagaatttcaaattccagaatatttcaaatgtgagtctatatggtgtcagtgaggtgttaaccgacccatctatgatttgcgaagtcttaagatggatgaactcttgtcatactctatcgtgaggaaatatttacaactcaaaatcatgcttaagaagaaaaattttctgagataagtcaagtctagccaggtgcagtggctcacgcctgtaatctcagcactttgggaggacaaggcaggtggatcacaaggtcaggagatcgagaccatcctggctaacacggtgaaaccccatctctactaaaaatacaaaaaaattagccgggtgtggtggcgggtgcctgtagtcctagctacatgggaggctgaggcaggagaatggtgtgaacctgggaggcggagcttgcagtgagccaatattgcgccactgcacctcagcctgggtgacagataagtcaagtctaaatttatttttaagaagaaacttttctcttttcctgtaggggcacatttactaaccagaacacattatgtctcaatttgtagcatgtgttttaaaattagaggtgactttagcactttctctaaggcaattggttagttgttttacatttatgatatgccgctcaaattaaaaagtcatctccaaatacaaaagcacccatctgccaatcttccttacttccctaattatatattgagcaattaattaccatgtgtcaagccctctataaatattatagtttaattttttaaaatgcacagagatatgtaattacaaatagtcacacctatattttagggaaagtacagcagcttatattggtgcgatgccatttgcgtgggtagagggtaggcagagaagccatccttaaagaactgagaatcaagctgagatctgaactgtaagcacaaatttagttaggcgtagagagagaagaaggaaatcgcacttgaggcaaagggagtacatgcaacatccaaaggttttgacattcaggggaaagaagaggggaggctgaaagaagactgaattttctggaccccagcatgagaaaggcaccaaaacataaagctgaaacttcatggaacctggaggcatgcagagctttggcagccacttgcagaattagatccttatgagaattcaaatcacttccttccatatagcttaactatcaggaatgagaatgaggatcacttacaccaacaagatttaactgtttattcttaactggagattcttgctcagaaagttaaggctgtaagtcaatgaataactttattgtttactttaggaaattcctgctaaccgatttatccaaacaaacacttgactcatctctcccatcaggacaaaagaatgttcacctgcagaaacagcttgcttatcaaacagcagtttatttgtcaagactcacatcaagactttcactttgctgtgctcaccagtcctaaacaattacatgataaattgtattccagtcagtttgtcttctaagctactcgtgttcaagaccaaagcctataaacatcctcctcttccccctttctgggacaccactaaaactcattcaaggccataggataaatagacttaggtttttttcactaacaagttttctggtagtctttggcagagttggtagttgtcaatcctgggagcaaacaaaaagcgattgaggatttttaagaaaagtggaagataggaccagcattttaatttggttgcagtttggtgagcagattggacaaagcacagaatcaatgtacagatgtggcagtaaggaggctattgctatagtccaggagaaacgtgacagaagcttggaatttgaacatgacaattgagataggataaatggatggattagagatgtgttttgaaggtagatccaacaagccctgctaatagtggaggacagggggagttagaggtgttaagcattaatttatgaatttttggtttgccgaactagatagaaaatggtgccacttattgagatggaaaacatagaaaaggagcaggtttggagaggaatgtgaggttgggggtaggaaatcatgagtcagttttggacatgctgagtttgagttgtctttgagatactcaagtggcaatgtcaagtaagcatttggacgtgtggtcatggagatcagaaaaggtctgagaaacaaagcaatggccaaatactcagaaaataattatttcatctccactgtgtttcccgtttaaatttcgtagtatatgcactcaaagggccctttatactgctatcctccaacttcagtggcaaaaagcagaaaggaaaattcttgtattcaggcttgagaaagatggcagggtggtatgatgtaattattgccttctaagagcaacttggttcttaatggccttttctttccatatagctatactaacaagaagttaagagcctgggctctggggtgaagcggacttagatttgactcttgaatctataacttactagatcgataatcttaagagattttcttaaactgagcctcaggttcctcaattataagttgaggataataataactaccacctcatagggtattatgagaagcaaataagtccatgtagtgtggctggcatagtacttggtgtgtagtatggactcaataaatgttagtttttgctataattatccttggattccggcattagaggattctcaagcttatagaattttggccataagaaatgccatgcctgcaaaattagagagttaaggaaacagaaaacttatactattttctaatgtacttcatgcccacacccaaactcaccgccaaccccatggaactataagggtctaagtatccagtgcttcatttgactaatctcatgcccgttgagaagaagtggaaaacagaatgaagactgagagctctcatttttcttcccttgtgacttacatttaacctggggttgtttttgtatcactagatgagttttccctgaaaagctagtcaagagtccctttattgcactgttgctactgaactgtggtccctaaagccaagagattcatgaaaagggaacttctttctgaatccagttggattgagcaatttaatccatattttcttgagttacattgtgtaaaataaatcctatacaaatttgaacaatcatacaagttctacttagttgaaataaatttgcccaaggtcaatctagctcaaatagaatgtgatcaaaacagagagacataaaattacttcaaactgcaatcaggccagttcaaattatgttaggctacttcagaccagtttaaattaaaaggaatcaaactggtcctgaagagcttaaattgagtcaaatttttttccagttcaaaattggctctaattgagtcaaggggattaagacatttcaagttgtatcaatccatttctagttggattagataagcatgaaccaggcaagctggctctgatcagctagaatgagacaaattgaattctaaacagtttaattggaatcaagctttatcaatctaagttaatttctgtgctgcctgggaaacaaaacattgctttaagaactggtgtcactccatgcttgtgtcatggtggcaaaaacgatgagttgcttgccagtgtccattctcatagttttcttcactactagtggaactacttatgtggttgtggtcatcaatgtgtctagctaaaacaaagcaaaaaacaaacaaaaacctacattttctcatctctcctgaagagaaatatggcaaatggagtgggcattgaaaaataagttcttttctatttcttgtgcctgaattgtggaaaaaaatggctggaactacagagttgcaaccatgggtaaaacatggtgacttaattcatctctaaggatggcacaataaaaatatataaggatcctgggtaacatggtaaaggtaccatctcctgtttccaaagtggtcagtgctccttccaaatctcctaggcactcaccagtcctgctgaagactttaccttcaagcatctgtactctctgtccaaaggattactagggccatagggggagcatggtgggggactgtcagggagctaatgcccctgggatcagtttcaaccaatttatcaaccaatggattaacacctgttcttccccagccctcagatgggacatctccaaggtatattttataccctttcgccgatgtcatgggtaggatcaagcctcagttgctcagagcattaatttgctcactaataatcactactgattctcttccctttcctgtctcactgtaccactcccaaaacagtgtttcctggcatcaccaaatgaataggatacttgctctcaaatccttgtctcatgcctgcctatgaggtaaccaaatataagaccatctctggattgtctatcttggaacttcttttgaataaagaaacataagcctctttaatcaaatcacaattatttgagtattctgtaatatgctgctaaaccctttcttatctgatctgattagcaatgtaataatttcttaagcttaaatctctttattattagtagtcctttttccaatgaagaaaaactattaaaaaccaaaagccagaagaagaatttaaaagccttttgatttaataaaatctgatgcctactaaaataaatattgaaaattatattctaaatgtttacttttagcaaatacaatttcaacaagtaaatggctttacattgccaactagtaaatttcagttcttacttgactcatccatagcttttgatagagttggtcctttcctcctttctgaaaaatgtttctctaattggtctgtaggcaaccaccctctcttggctttccttctgcctcactggctgcttctttccagtctcctttgctggtttcccctcatctcaagctggtattcttaggctcaatctttggcctgtgtctcctttttatcaacaagcatgctctacatgatatcatttgatcccataatttgaaatagtatccctaggttgatagatcttaaatttacatcttcaatcccaatttctcccctgaagttgagactcataattattacttatataccatctgtggttggctggtttttagacagctcagtttttacatggctgaaaccaggcaaaaccactgttcctgcaatcttcaactcagtaaatggcaactcctttataatggttgcccgggccaaaagcatacgaaactagccacaattcctcatttcgctttcaacactccacaccagtagccaaccctatcaactccacctttaaatgcttccagaatctgaccccttttcaccatacctccactaaaatggtaatataaactaccacaatttcttgcttgaactctttcaattgcttcctattttagttctctgagtctactcttgccccacgcacacccaattctctaagcagtaatcagtgtgatcttgattcaaatataaatggaattacatcaataccctgtccaaattttccagtgtatatccatctaactctaagtcttcacctacagaacccagtgtagctcactcccagacacttttttacttcatcattcaccactcactctgtcattcacttggcttcagccagactcacctccatgttgatccttggacacataccatgaatccaactcctcaggcgtctgacttatcataccctctatctagaagatcttctaatcagctacccttgtgcctctctccctcacttcctggaagtctccattcaaatattacctcaacagaggccatgactaaccaacttttctaccatagcacggcccaccacactctcccttccatgctctatctttttactctgtttttcttcagaatatttattgccacctgacatgttatatatttatgtgtcatctgtctccattaggatgaaaatgttagaagagaaaggactttgtctattttattccctgaatatttctagtacctagataattgcctagaacatagcaggcacactataaatgttttaatgaaagaataaatgcattataatcatacttttatcaaaaaattatttttgaccacttagtcaaatacctgattgagtgtggtatgtctgaatatttcaagaaaaaataatgaaattttcaaaatttctggcagcagttttttttttacattgatcaaggagctgccctctctcgtaaaaaggcacagcaggagttgaactgtggctgagatacccatggcttacccagtaattgagaaagactaaacaagagagtccactctttgctataactgctttttccattttattcaaggtgttaactaaaatacagagagctttcaacctactttttcagtcattaaactaaaatgccaaccaagtccagttcacttctaaaatgtattggtacaatccagtaaagaggagatgacaggaaaagaaaagtcaacaacactaagtatagtaatgttcctttttgtttcatgaaacccaaattgttacaaacatcaattttagaaatattttatgtagacattaaaacaaaaaggcaacaagaaatgcaaaataaacacacacacacacacacacacaccaataggtttcacctgagaatttgaagtaattcagagacagatttaatattctttgaccaatagagataccgagaaactgtgcacactaaaatgaaaataagcaataaaagcaaatagtactcaaaatttaaatgacattggttaacaatggagtacgaaaaggttattgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgtttttaacaagtattttaccagttctttacaatttgcaatgtcctctcacttgtctgattcccataaattcaaattaaagcttatttgaaaggaattcatgttttggcaatttagggaccaagcacgttctcactaacagtcagcttatcacctttgcacttaaaatcaaccattttttatttatgaagctccaggcataatccaatgctaggtaatttggatattcctttttgctgatcacagcagagacagtcctaatctgacaggatggcatggtcacaggggaaggaaaatatgcatgaactaaatgtaggtatccagataccacccctaaatggggcgcgcatagaggaaagcaatttggcaggagtgagattgctttccagctctcaattatttttctgctgttttttcttcaaattgtaaatcaaattcttttcttgtgcctcagtgcactggtccctgcatcttaagtggaggaagattctgacatttctatttggatacacggtgacttaatgtacacatttctgtggaatttgtctctccctacccctgagttatgttccatcagtgatttagtcatttaaatagagtctcgttgcacatcgctgtagcaccaaataggatttgatatttaaaagttgcttaaacccaaggaaaaataaaataaaatgactttctttctgaccaagcagggcaattcgataaaaagcttctgaccaggcatcattattgcctttgattaaaataaaatgataatttccataaaatgacatttctttttaagaatttgttatatactcagtgttaacaagaacagtttttcaaaatacaaagtgtttttcagggtcgggcatggttgctcacgcctgtaatctcagtactttgggacgccaaggcgggcagatcacttgaggccaggagtttgagaccagcctgagcaaaatggtgaaatctgtctctactaaaaatacaaaaattagctgggtgaggtgctgcttctttgtaatcccaactactagggaggctgcggcacgggacgcaggggttgtggtgagccaagatcactccactgcattccaacccgggtgatggagtgagactctgtcttaaaaaaaagtaataaaatacaaagtgtttttcaaactatctgtggggaaggatcagttttatttttttcaatgcattataaactaatactttagtaaaatacaataaaaatcaattactagcaaaatgaaataaaaatacaagcccaattttgtttatttttaagttcaatagtaaagctaatctgttaaggttgctataaaagtttctaaatggaaactgtggatttccataaatttcttattgcagactggtgacacagatgggttgggattgctgctgtggctttcttccagtatagtttttctggaacaatcacaaaaactaatttgctttatactttcctcccacgtaatctgggttcccaatgtgtcccactttctatgtcaacttgaggagagttctgctgagtgggatattgaaatctagttcatggaaaaaattggcatgaaatgttcatactttgtatctggcacccaaaactatcactgagacttacatacctccctcccctgtaaagtcatctcttttcttttcttttccttttctccttccttccttccttccttccttccttccttccttccttccttccttcctccttccctccctccctccttccctctctccctctcttgattgcttgcttgctttctcttctttctttctttttttgtagtttggggtcatcttagattttctgaagccaggtggagatacaccacggatcaaggcaggggccagaattcagggcatgaacagcatcaaggggagagcttaagtggaaggatttcagtccaagagaagtattaacatgtcaagacaattcagactttgatgggctttccccgtgcctcccccttctgagggggtgctccaatgcagtggctatctagaaggcagagtttttcctgtctcactgtactcaggagaaattagccacagtcctcaaaagctgaaggctgattaaccatctgagaaaagccaacctagagagtcttgaatgccagcttctgcagatgtgaaaagttagacatgtgagaaagcatgaaattcttttatttgctttattaatttttctggtatttatctccataactaaagcattatggttgccagtgaatttaaggtcttcagaaccatgttagatcacaaagtctcacatcgatttacatctctgtttgccttttagtttcaatttttgtttaagtatattcttcagtggaaagtggatttcatctgtttctggtgatgaaagagctcaacaatatgtctcatacaaatacttcttaaaacctaatgaatattcttatctctgaactacatatctgaccataaatatgaactgaattattctgcctgtaaatatgaactggattttcctttacacgtgcagctcacaacatgtagagctgaaatgggctttggattcagctaaatatatatcctctagtgtgtaacctccatgttagccaggcaggttgttactaaatgaacagctgttgacagaaagcatttccttatcgtccaaacatatgatagtgcaaaaaagaaagtggttgttttagtcttatataaaaaaatttttgtggtaatggttagctttacatctttaaaatgtattaaacggatagtttcaccaaataaaaaaaattgctaacccacaatatagaagcttttctttgtatttccaaatatgtctgagtaatttgtctcttctcccaaatgagacatcttacataccagacatttgccctcccaacacagcttgcttttgtccatagccataaactgcagaaattttgattatctttcatcatatagtcaattttgctccccattaaggaagaaaccagtacttgacagacaagtactttagcaccttcatgtttcttagagcacctgacaatgtaaagaggggaaaataatagccttcttagtttgtgttcaggtaccatctaaatctctctactttgttgttgttgtttttcttcctgatttagtcttaggtaaaatgatctgatttctctgttgtttcatcaagttacacattttccttctggaatagaaaaatagcaagggtgctgccctttttgaaagctacttgatccatgcagtaaagaaaactaaatctcccattgcattgtgtagaaggggtcacactatacaatttaaccttctacggcaattgtttgttaatgaaaaatttagaacatttttcttaaaaatgccaaatcgaatgaaatcattcactctattttcttcttcttctttacattggtgttttggctgtatagtcttcatgaaaaaagaaatgtgaatgtttacagcaactttattcaaagcaacacaaatgtacttcaagtacagaatggataaacaaaactgtggtatacctatacaatggaatactactcagcaattaaagggaataaactaccaacacaacatagaagaatctccaatagattatgctaacagaaagaagccagactcaaaggctgccttctatatgtttccatttatgtggcattctggaaatggcaaaatcaaatggctagagaagagatgagtggttgccaggacttgggctgaggggaagggttgactacaaagggtcagtcctagggaattttggtgagtgatgaacactgtgtcatggcggtgggtatataaacaccagcagacaataaattctgttcgaagctgggcctttgcactcttgggtgcaaaggaagaaggcattttgaacatggtggaacttgaagcttttcttcctggtgggctgagtggaataatgggaactgcatggctcaaagattttgggggctctaccacacatcagattgaacatatttaaatgtacccaacatacttattaaatataattcatatgcaatcatagaagatttcagttgaattgtgatggactaaattaacataatctttcattatgtttgtttttcagttttccttttacattttggatccatttttaaaactagcaagtattttaatgtggccctattgaattccatgctctcaatgtttattttgcctgatgattaaataaacaagctctgttcacactagtgtgatcaaatatctagtttgctcaggagacacccattttatacatgttttcctgtaattatcaataacaccccttttcatggccataagtgtcccagttcagatgataaactttatggattagaccgaccatacacagaccaacagactagcttagactgacttgtgacctaattcctgagattctctgtgactttgggccaatatttaactcctctgggaatcatatttctcttccattcagagccgataatcctttgcagggtccttatgtggactaaatgaaataatgagaacacaataagcatagtgcttggcatactaggcactcactaataggaactaatattatttatttcttaaaataaatttgtatttaatcaatttacactcccgcttggacttttattacattatttcattattatctcttgagacatgaacatttgcaagtgctatgaaaaacatgaaataatttattttctccccgaagtgtctaaactggatttaaatatttatgagacaggctgcaagtttgaagtttcagaaattaaatattgcaactcatgtatgccattaatcttccatttaagttccaggattttttcaaacgttgataaagtcaacttacatttttcctttacaaagtaacacagtcattgataatcttggcagattttttggagggaagttttccactaaaatttattgtgggcagggatgagtttttattatattctagaaatttctatctgttgcataagttgttagaatacaaaaacattttaaaagtaaaaaaagttactttttcttggacccatgaaaaggccatgtacttaaaattcatgagcttatttccagcattgtgcagtctccttgtgctttcttgtcacttatgtctttatcaaagaaaggttgaagaatactatttggtatgtcccaaacgtacaagaaaatacaaatcacctagattcaggccccaatcagagcagctgaatttgaatttcagtcgaataagcctagtggtctgtatatttaccaggccacccaaatgctctttttcatgatgtaagtttggtgaatgatgatctcttacttaggactttgggagaggcaaaggtgaggttggaggtaagaggagtttagtaaaggaaaagcaattttgacagaagaggggagaggaaattgagaatttcctctcgcattgcttatgtcgattttgtaataaaacaaaccagtgaccttcaaagaagttgttagccaacttttttgttaatcataaaatctaataaagtgtttaaaacacttaaccatggcccaggaaacaatgagcctcttagttttgattgctcaaagaatcaatttttctcttctaatatattttctgccatttttaaacctatctaattcttctcttactccttcatacaaccttactcatttcccctgatacctccccaatccataatttagaggtaaaatgcattagtatgagtctctcaagtttaaattatgtaaaattggtggtctatagcccatgaaatcatgtgcatccaagagatcattttagcttggcagaatatgaagaaaaaagccatactttgattggacatacctttttcaaatatgaattttacccttattttcctcctgagtatatctgaaaatcagacatgcgcaaaataaaagaactgcctcattcatgttctttccaatacagatgagcaaagctacagaaacaaagagtttagaaaccccaaaagccagaaaaacacagtgagcttcacatttggtgtttacaacatagtgacaatgatgacagcacttccaataaacctaatgtcagtcatatattcaaggcagctgaaatgaacagtcataaaaacaaacgaaactgaactgaaagctttagctgaacaatggacacaataaacattttatacactctataaagcaaaagcttaatacccagttgtgtctcagcagccacctgagctaatagctcctgagtaactgttgtgggccaactcccaaatgtctgcctatgttgggagatccctgtactgctccctaaatgcagttattcagtagctctctaccagaggtgctaccaactcccttggggcatttggaatcatggcaaagcattttggatggttgcaatgactgtggagtgctacttgcagttagtgtctcatggttaagggtgccaaacacctcacaatgctgaaaataaatctgcccaaggaagaatcatgttatccaaaatgccagtagtgcctctgttgagaaacacttctcaggagccccataattcccaccgacatctctacactttttcttgacatatcctgagacctttaagtttttctcgggagtcattaaccttgctttggcccagagcaaagtaaatgggatcttcagtgcttaaaggtatgttcatgttgttttccaaggattcataacatattcaatgagtatcactccatctgagaggagagaatgagtacaatcccaggttcttctttaggttctatgggcagtggtccaatatttctgaatattgtgtctggccatttcagcaggcatacgatgctttagtttcggcactactgcctattacaataagtgggtcatattcatgagtttttagccacacagatgtcacattcacaccttacccacacacttagtgagatgagaagcacctgaaatacactctatagaagatgaaaattatgattcattttctcacgggttttctcagggcaactttctctgagaattctattacttttcaatatttggcattgggaaattagcagctacaattttctcttttgatttattccactctaacaagccactgacagccaacgaggctcttctgggcataaaggcaaaactcctacctagcagcacaggcacagatgtgggaagcggccccagtgttggcacagcaataattttacattgtagaacctgcatatcaggcttgggaggcctagcttcctgaattacagaattactgattttatagtagatgcaggggcctgacaaggcaggggatgaaaaaagaagggagcccatggcgttatgctgctttgacctaagagacatcttgttctatacaggctgccgagacattccaattatgccttggtgagattcctgtattcgccatcctgcaccctccttcctgtgcccatcctcctgtgtgactatctacctgcccccacctgcctgtgcccacctgcctgcacccatgcacctgtatcttatcttgtttataggttttttccactgattatttgcttcaggagtaaactgaagtctaagttgtctttttgacctttttgtttgtttgaatacagttgttcattatccatacaaagttagttgcacaccacaggatgtgttctcagctctccctataccttctctttgcatctctatttatgtcattttcatgttttactgcacttctttattcagctatagtgcatcctaaaacaccttggtatttcaatctcagaggcaaaacctgaacttttaaagtcccaagtgttatgtaccttactttacttctgtcgctgaatcaaagaaagctaccatgaggatactttaaaataattcttattcctgtattattcataaaaatattgagaaaatgttaagtatgaggtgtttgttcctcctggaaatctttataaatactaataaagagtctttaccattaatgctgtaaatattaaccaacggtttttaaaagcaatccagaccatttacttgagtaatgaaatgcttttgatttgcacattttgagaaaattaatgaaagcaagttacacattattttttatggagcttgctcaacactcctagtgtttaaggttggaaattactctttcctctaaatcatgatgtttctattgtgtccagggggctacaggctacagagggatagaggggctcccacaaggggtaagaagaaagcaaagcaggcaggacccacctctgcctaaactaagctctgctttacctgcttcgtatgtcagagttctacgtaagagtttgcttggcaaaaagggctctggtatttaaaaagacagagtttgaattcgactggtaatgtatttttgttattattcaagatctttttttgggaataactgcaaaatagccctcaagatgtcagctaagggaattcctacatgccacgtctaaggggagaaagttgctcttggagtctggcattctttcccaagttggggaagttgtgagaaaggtcctagagaaacatgtggctctgctgaaaccaagcttcttttgcttaagagtttagggtaagtgatacacgtcaagttatgttcaagtcaagtaatgatagtaataaattactatttcacacaattgaacctctacgtacgtcctaaagcagttacataacaaaacactatcaccttccccccaaaggtctcttttgcttcttccaggtaatcactattcaactcctactttcttactctcccatatatgcccctagggtttcaagttatctaccagccatttgaatgtcttctttttgtgaaatgcctatttatgttctttgtatatttttgttttgggtgatcatctttttcttacaaatttagaaaaaccctttattattaagaacattaattctgactttacgtgttgcaagttatctgcttttaactttgtttttagttatttcctgaacaatttttatatttatacaaacaaacatatatatatctaatatataaaaaacaaatatattatatttgatatatcaaatatatttattatatattatatattaatatatattatatattatatattaatatatattatatattatataatatattatataatatatatttgatatatcagatatataaatgtttgtataaatatatataggtgtttgtattatatatatgtattcctagtatatatatatatatatatatatatatgtgtgagataggtggtttgtttgtataaatattatatatattatataattatgtgtgtgtgtgtgtgtgtgtgtgtgtgtattccaacactgtggtgttatacttaagctctctctgcccacgccaagattacaaaaatgtgtgttattttctgatttgattatgacacttaaacttttaatccatttaaacattcaattttttaccttgcatagagatacactcctacatccccacatttaaccagtagtctcaacactgctgatggaacaagcctgcctttccccagtgtgtattggaaacatgttcgattcctataaataacttgggcctaagccttctattctgtaagactgatctgtctattctcagaataatccaagttgttttatttatataattctataatatattcagttcctagagaactcccctctcaaaatgttcttgccggttactaccaacttagtctcctagaggacatccagaagtgtttttgatgagtttaaaaaatcatttaattattatgattagaattatattaagcccatgtataaattagggaaaaattaatcttctcacctaaaattatggtgtttttcagtttcaaaatgaggtaaatttaaaaaatatgactgcaattttgtttgacacttctctcaaagagatttcttgaatgagagagggcttgtggcacactaatcaccagtggggtgcagtggaagagatcctgtgtggcctccaaggcaaggtcaggagaggtggactattgtccaaattgttctcaggtacactgactttcccaagttcaactctcctaagcccactatgaggaattccaggccacatggagaggctttcctgtaggtgctctgattgacagctccaaatgaggtcccagctaagggccagcattaaccaccaaacatgtgagtaaagacgcttccagaatattttggcccggacagtaaatcaccttcagctattttagtcttcccagatgagactctagacatcatattccctctgtgctctgtcagaattcctgacacacaaaatccatgagcataataaaatactgcttaatgctcctacatttggagtgatttgtaaaacagaaatagttattggaacattaagtggtttttttttttggccttaaacttttatagttttcttccatagatattatactttatttaagttaactcttagttatttaatatattttttttattatggtgataaaattattctgactaaaaagctaccttctgatgtaatttttcattttctagctcccagtttcttaccttttgtgtagttattcaactttgtacatctactgcagtacatttctaaaagtattttatttgatattcttaggttttatagatatacaatcacacaatttaaaatgaacatatttgggtcttctccatttaaatattataaaattcaggtcttttctggtcattatattggctggtactctcagaacatcattaactcatggtggtcaagccagacgttcctaatttgttactgagtttaaggggaaggtatttcatgtttaatatatatagttctaaatatcatacaagaaaacaaaataatataatcatgagataaactctaagccctactattagttttgaaggtcatatattttagcatatttcaagtaattttttttttgctacatttaagtgggagaagtaattttggattactttttttatttacttgttcagagataggaagaaaatggtgaaattgctacttaaagcatgcttctgcttagctttagaaataatgacattctgctgaatggagcaataaaaacagaacctgcgcatgatcttgtatgctacaccagctgactaatccatctcctcagatggtttttcagagtccaaaaatgctacataaatttttttcaacctgtgtgagtggattattttgtggcttcctgaaataatcctctcatcttttaacacagttctgacccagtttgagagagtatctttaatatcttgttctacttcactgacctcaaggcagaatagccagaaatatatgcatttaacaggcaactttcatcttcaagctcacagaagggttggctttctttaaaaaggaaattgaaacttatattaccaggcagctttttagatgattttactttccattttataactccagcaaataggaagcagagatgtggagtgagtgaaggagatatgtggagtgaccaaggtgcctcagaatagcgcataacaattgatggaagcaaacacaagctgtcacagcgcctgcttttacctcaccattgattattcatcaggtgaaaggcactcatcccagaaagaaaaacagaaacacacgtatggaagacaaggaaagtgggttgctagaacaaaacacagaacaatagcccatccagaggagtgggctggtgaggtacttacagaacacaaccactctgagaattcacaacacactctgattccctgagtggatggttaggagcatgggtgttttctagttggtaaatgtgagactgattgttatggttattgcctgttaaaaataaattttattattgttcttcattatttaaatgtccttcttgcctttgcctcataacccacacacagggcctgctgtaggaggagtacatatctctgttccattgctaagtgaccacttctgagctgaaactctaagagtcattgtgtgtttctgccaggctttctcctttccctttggtgcaagaatagcatttcccagacaggggctcctccatcagtctggatgctggggggaagaccatggagcagagcagagctgtgactgacccccagggcatgaagcatgatcaagaaatacacctttgtattataaaccattgagatttggctgggaaaggtgggtggggagagggaggcttatttgttgctgcagtgtaactaagtgaaacctaattcatatgactcaaactaaggtatatttggttagatctaggtgagttctactttagaggaaatcctggtaactgttgtttgtttgtaagttatagctgtaattaattttccctgtattcaaagcccccaaaccctgcattcagatactatgcatttagacttccttaggcaaagtcaaggcaacaagctgatgattctaagctattattcaaggagtatctaccatcataaaggtggtttagtcatatagataatatcaatcaataatacaggagatggcaaaaattttttgtgaagagccagatagtagctgagtatgatgacccctaatctcagcactttgggaggctgatgggagagggtcatttaagaccaggagttcaagaccagcctgggcaacattaaaaaactccatttctaccaaaaactttaaaaaaattagccgggtatggtggctcatgcctgtagtcccaactacttgggagaccgaggcgggaggattgcttgagcccaggagtttgaggctgcaatgagccatgatcacaccaccgcactccagcctgggcaatagagtggcacactgtctccaaaaagaaaagaaaaagctacatagtaaatattttagactttgcaggccatacagtttctgtggcaaccactcaggttgtaagtgaaagcagccataaataatagaaaacaaatgagagtggccatgttccaatacaactttatttacaaaaaaatgacaatgggatgtgttttgcctgtaggctgacccttgttgtagaataagaaacacgaacagcggcgaacgaaatctaaataacaagcctaatgtagcatgttctacaactatgtttatatggttttaaaattaaaagctatccaggagccattgaagaacatggttaagttcttggttttcctatatgtaaaatagagacagtagaagttatttcataagatttttgtaggaattaagatgaaatataaagtgtgcatgagtgagcaagtgcttaatgaattccagcttctttaatctttctgtgtgctactattcaggactcaaagtagattattagtgaaggcctatttaattcatgccaagttaatgaatgaggtcaaacagtaataaggtgaagcacagaatcctttaagtcgacatttgccgagcaattcaaacttacggtaatgaagaataaatattaatatatgtcatgatttacatgtctatcaattagatccctaattatattgatttgacatggaaatgctttatttttattgcgggggtacatttggaatgatagaaaataattatctgtgttccacacccaaatcatgaaattctttcctgcatggacaagggatagaaaataaaaccctattgctatctgctatattaagaagctgctcaattaaacagaagtcaattttgttattcattaaactcagattgagacatcaaattttctttcagaaagcagtggatctcaatatgttgctctgtgttctgttaaataccttccatcatgaataattagtgtcaaatgtgctcagaagctcatggccaatattcatcatctttggtgcatgggccatagtgacaattgttgagatacctgaactttttctttttgtaaatctaaatgccaccagagaaaaatatatttgtttttccaatacattctctgcctgatttaacgtttaaaatttatcttcctaggcctctacttggagttcatcctgttccaaaatattaaaattctcttcccttattctttccatttcttcttcttcttctccttccccttccccctcccctttcccccacccctcctgctcctcctcctcctccttcttcttcttcttttttccttttattgcactccagctctgttgcccaggctggagtgccatggtggggtcttggctcaccgcagccttcgcttcctgggttcaagcaattctcctgtctcagcctcccgagtagctgggattgcaggtgtgtgccaccatgcctggctaatttttgtagttttagtagagacagggtttcaccatgttcaccaggctggttcgagacctcaagtggcctcaagaggtctggcaggccacagcctcccaaagtgctgaaattataggcatgagccactgcacccagcctccatttcttctccattgttaaaattacacactttaaggtaccactcactgcagacctactgagcctccagtctctaagaagttgtttctagaaatacaatttttaccaaattttcccatgattttaatgtgaaaccaagtataagaccctccttattaaaggaacatgaagaacatgagagatgctaatagtcatcaccatcaatattttcacaggggcataaaaaacagcactagggctgtgataagggtaataaggtgacaggtgcaccaggtgagacaggtgatggggtgataaggtgacaggtgggccaacaattgttaggaggagttttcttctctttttactttgtacctttcctttagctaagaacagtgtctaatcctgggccatcagatttcttacacacagaaatgccaacacataaaagtgacatataagttggagatgcaagaaaacaatggacattaagataattgacaataaaaatttccattaaaataattgaaaatagtgaaccagatctatcatatctacaaaattattgtctataaattcaatgttgtattttggtgttcctgatggccagcaatgcaggggagtgaaaatgagatatgagagtttaagcattaaagggcagaaggatactgagaaatccctcagtgaaacaacgcaatttaggccaggaattttccactctttatcctcacaggccctttttggtaccttgtgtaattatagcagacatatagggatgtctctgcaacatggtgcctgtcaggttcctgcgtttttctttttgcctctcagatgatttttactatcacaggcctggggaaagtgatttgcacatgaagcattttagcagaccaatcaattagaatcagcctttttctgtttatgtcaacagccaaatgatcgtgagaatacccaggccatttgttacctcccagggatttagcatccagcaccttgggttgtctgaagttctttccagggagctgcctccagaccttagacacaccacgagaaaatgtctccttggctactgacaataatgaatcaactgcataaatatatctgtcaaaatgatggtgcatttgtctatctgaatactagagaaggaagggtaggagagagtgaaagaaaggtggaattgagtagagtctgacacctcacaaacttagcaattttggtaaaggataaattcacatctacccatacatttctttggacatctgtgcagaatcctcaaatccaatttctttggaaaagacagtctccaatatattttctgaatcaaatggatttttagtttgtttgtttgtttgtttgcttttaaagttaatttataatttcctttgaaatgaagactgtagacatggccatatctaagagaatatgaatgaaagatttaaataggggcattcatggtcaatccacttcctttgtttatcctatcctgtaaatattttcagtctactacccatctgtcactccattctcctgattccagctcttatcaggattgtggcctgtggtttaactgactgcctttgccagagagttaaaacgagtctgttcctgattcacagcaccagctagatcactagggccactaatgatgagtttagcaaaactccctgccaataacatgaaaccattcaatggctgaaaaatgcttcctgtctgaattaaccccccaaatatttacaagtacagcctacaaaaaaattcaacagcatgcaaacttaattactcaacagtgatgaaaagtccacttattcttgaagccagagaagggaagttaggtgagttagaaagggatgacttggtgttttctcaccttcctcctggaccaaatcaatggcatagacactatggattgatttggaacaccatctagtgaaggatatgaggaagcgcatggacgtagaaaatcccacatcaactcctggttcgattcatttaacatttcctttagactattttaaatggttctgaaatgaataaggatgtaatttttttaagttatgaaaaaaacaaaacagaatgaccagtgtgtactccagcactgaccagattcagctaatgagtccacttgcctctttttctcttagcacttccccactgactacagtaaggatgtaagaaacacccccatagagttgatacaatcaagtttccttctgccggaatgtcagcatctggaatggcaccaaaggatttgagaagaatgatgccaggacaccagattttcaaacaagcatctatcagccatggtatttttcagttaaacaatatatgtgtaagaggctttagctatcaaaaaatttaaacattttctggaactcaatagcttttatcgtcagaaaatcggtaccaacagcacctatttcacagtgtgctgcacacaaaaaacattcaataaatataatattgttcaataactagaggtggcagctagaatttttaacctgggaagaaagctgaatataattcaaccgttacattttgaattcttctatataaaactgtgtcctcaatttatttatttatttattgaacttctcaactccacatttcaatgtcttaccccttgggatgttgatccatgtgctgttagcactgaataaatattatatgactgcctctaaacttcccacagagggaaaaaaagacaaagcaaaacaacaacacaatccctcacattcaatgttgtggttcttttactataattatcaattcccgaatcaatcttgccttcatgtaccctagtctgactttcaggaaacctcactgcactgttcctgattggaatcttgctttgtgttttctagcggttgctctgaagtcacatggtcagcctgccatttggggtatcatagtttctgtgagtaattgattctatccagtcttaaatggaaataaatgctgtgtttgtattgctcagcatgttaaattttccttttaggtgaagcagaaaaggttacataaggtctgaaagcctcaatcataggccactaggaacacagtgacctcccattacactcttggtcttctctctaaaatcagaagaaaagaagactggccagaatgctggagtgtctctcactttctcttttcaactcttctattgtttgaacaatgactaattagctgtcactatctttaatccagcaatgtactgactaactcatgcctatttttagcaacaggtgaatcttaggacatttcttcaagaagccagcactttagactaatgggacctactttgatcttagagaacagaacagttttcaaacattccaactgtgcttccctgattttgtgtgtctgtgtttgtggtccttgaaataatagagaaggaaggtttttacctagcaacacattttcaatctgctaggcaacacctgagaagcacctgaaggcaggcagaagtcctctactgagtggtttcattcgccccagctgaacagctgacacgagctcccgaggcactctactgaggataattagacttatactcagggaccggcaataaaacatgaaaacaactatgatataaaatgaaatgggctatctgtcataactgaagaataaactgtgatggagatttaaatcagggtattctacagccaatgatgagggccaatggaaaagagtgctttgggcaggaggttttgtactttagacaaaggtcagattttgctgtcattcaatcagctgtgtgttgtgtaggcaacttattatcattcaggttacagtacaagaatttacaagtgactcctcctcctctttctccttcttcatcaaagtaaattagaaaatactgcagattatccccatataatattcctctcactcttgctctgaaatattttaatgaatgggacagaaggcgctaaaattacaatcagaagagcacataactggagatgctggtttcttacaaaagtacttatttctttatgttgttgttctggtgtgattattgatagtatccttttcagtttcaaaaatgtcctgagttgggcaattcatcctctggtcaccagacacgcaccaacagtctatctcatgaaagctgtaacagcacacggagtggcacaagtgggtatgatgcatcgtccacatccactgacatcaccgatactgtcggcctccctctgcttaggcttccaaaacaccaggtctaccgagatgcccaaacaacattgcaaaggcaaggttatgagaaatgccacactagctgtggaaagagtaccagttgatgtttccagtgtaatgaaatgatgcaaacgcccactgtataaaaatttccgtctatcccttctctcctcttgcagccactttttttttttaacacaattgctacagctaattgtcaatattaacaacacacgcacacacaatataaaatatacatatacgtatatgtaatttgtcctgcggcttcatatggatttcaattcatatcttcttcaaactaacttattttcagcttgactaaaaagttgctaattcattcgccttagctcatttttttattttcaatgaacattagtctctggtggatcctataataaagcattatacattttaaatatttttgaaagacagaggacattatctgaaacacaaagtcaacctttgtaataaatataaaagaagcgtgctttgagagaaagaagtaaagaactattgagacaggagaataggaattagggtaaccggggttaaggcataaacaaaagaacaacaggtgcagccaattcgcataagcaaaagaacagcaggtgcagccagttctaggcaagattgggcagcttacgggccatatcctcgctcctgtgataacaagacaggagtttccagttcagcctctgattgagggccaagcctcacttcagcctctgattggtcacaggccaatccttcaaagggcataaccaattggaggcctctaaagggcacgtggggggtgttgccaattcttttggctttataaagccctgggaccattgtggtaaggagactcttgagccgcttgctggtgtttgtttctattctgtgagttgtcttcgctcagtctgtgctttttctttccttactccgttcttctgttgctttgtctttcattgcttcttttattccttcgtgtcttctgttcaacattccgagaacctgggtaactagaacctgggcaactagatcttgtaatgctatttgcctatgaaaataggcaagctggaaatatctagtagactagaaaaaaggctttctagaacttgagtggaggtatctatagaagataggctaatgtgaaaactgaaagactgaaacagtttgaggaattatctccctataagcccaccccttcatctagtcttaactacaatcgtgtctcatagacacggagatctatgcactgagaaactgaactagatttctgctgcgctggtgccccccgatggtctcgccatttcatggctcatagtttttagaggaaagtcccttggaaagctttttttgtctctgactaaacacagaagtaggattaaatggcagggctaaatctagcttcccttttcatccccaaccaatcttgtttctctccccaatatcccattgaatggcaaagggtaatgaggctgaagatgaaaagaacaacagcaaagacttactgatggctgtctaaataagataggacgattctgaaattaaacccagtaggcagaatgcttctaaaggctacccaggcccatgtgctgaaacctatttcgttaaagtactgctgtggtttctcattccacacacacagtggtacctgactgagtacttcactgagaagcttgagcagaagatgcggctctgatgtagtgctgttaagttctctcaggtaactttagggttttcgacagcttttccttttaaacttaagggaggctagatccacaaaccgagcactagcacaggctggcacgaaacacagcttaactttcatttcaggcgttgtaggggcctatctctcttgctgacagttacgggtgcagtttaagcacaatctatttaagtggtgcaccttgcatggagatagacatgtatggtgaaagaggatgggagtaacaatggagtctgtgccgcagccagtctctgcttttagataatgctctgtatctagttactataaatttgggatagccctggcgatgaggatgctgtgggacactgtttgcttctttaaatcaccataaccactcataaacccagtctcgaggagttatgcgagtgtttttctctgtcctttctcttaacctgttccccttaaatatcgttacaagaaaacgtccactggagcatacttcatagcactgtgacagtagcagaagggagaaagtgactgttctagaggaacttcccccagctcttagttcctttgagtatttagaaagtggagtccaaagatttgttagcatttgagatgttaatggcaggttaaaacaatctaggctgctggaagacaagagttttctatttaagttaacaagataattaagttctcaaataactaaaagtggctagaagtcaaatcagtataagatgatggcaagctggtagggcttctgaattcagttgagaacacaatcctcgttttttaacttggttttgaacacttcattgtcagcagtatttaaatattaaattttaaaaatagattcctaaaggagagtcataacgggcatcttcttaaaccagctactctttaaaatcaaaatgctgtcactgccaataaataagtgcagtgtctttttcttatgggtgagtcagttatttagtctgatttcaatcttctaagtaaccttgcgaaatattaaccacgctacacaggccccacccctgactgcaggcaagcagaaattcccttcagattgtgtgaatggagatagttccaatctacgttacatgatctatacacaatagtatgttttctgacatttattcctttgattcagaaattcttcctcaaaaccatgtattttgaattctagtttcaaatatgtctttgaaaatatccatggcaggtttgtgcataatttgcattttgcttatttaccttggttgaggtttttccttagtttattttttaatttttaggaaaaaattctcaggttttttcaatcctaaaaaaccaaatttaaggaaggatagtttctttgtagaaaggtgattaatgaaaaatccctgttcttgctattctgtcattgagctctttcaaacaagcgtcggaagaccaacagacttaaagataacttgttttcttacagtacttaagatcactcttgtttacttgcgggatgtggcttagagaatcccagttcatatttagataatatgaggaaaccaacgtgaatccagtgggcacaagtacaataaatgaaaacttaatttgctttttaactaaacttacaaatacatgtgttcctatgcaagatttatctaattcataaattgcaagaaaacaggctagcttccttgtacacttaaatctctgaggctcctcactcaacttttgttttagtggaccctgcaaatgaggtaactagaccattgatgaatccagaagagggaagcaattgcctaaaatgacatcactactgttagcacgctaaaagccatggccacctacggattttcccaaggaggactgaggtggtgagggctacttgcattaccaattgtattctatattttccaccttcaaatagtaaactaaattagtcacacaggctttcctgaaaaagcgtctgattgctaatgtgcctcccaaataagtaaaaacccttttaagaaaaatagacaaggttgtggattggcttttgaagtatggcttcatccttttttgctttcctcatggattacaagttcaatgtgaggggcagaaagcctaccattttattttttcaagatgtgtaaaggagaaccacatgcaagccttttgtgggggaacaaactataattctgtcaaactgatgaaacaagttatcaagtaatatcttagcttccttcaggaaagaatatgttggggctacattctgataggatatattcaaccataagccttaaaagcatgaatcctaaagggatatagaaaaaagcctcataggaatgccaatgacggactctcgaatcttcaggagttctgggagcatcaagaatatggagtccaaattctaccgctaagctgacagatgacaaagagtgtattacctcaatggctaaatatttaagcttcatggagtttggaagatagttgactgtaaatgagccaagaatacaaaaaaaaaactgcctgtgaaattatactgcagacataaaatctcaactgcctaagagctctggttcttctaaaagccgtggctgacagagcaaattaagcagtgagatgtttactatgtttaacagagataaactggcaaatgtagaagatgtaattacccagcatgtttttctaaaaatgaattttaactctgttctatgagggggcaaaaactgcagggcactgattttttttctgaaagtctcatgtgcttgggtaggatttttaaattattcagtaacttgataataaatggtcaaatattgaaaaaccaagagactttcactgaggaagcagaccaaaacgggggagcactttagcattttcagcatctctgaaaagatttctggttgaagaatattgtttgatctagcaagatatccagaggatttagcctacccagggacaacgcagtgcttcacatagagaaaattagccagttaaagctgacttgggactctatagtgaatgtcatacagatgacctcccaccacaaaaactaacctgtaccttactgtaaatcatatcatttatatttgtcttgcatgcaataggagataattactgactaaaatattcaaagatgtttacatggtgaaaccatcagcttgatttattaacctggatgcttttcttattaaatagcaacaataaatggagagttccaagccagcttcttggaagaagatactattactaaaaaacttgtttttctatgtagatattctaataagctaaaaacttctctaagccagcactggaataaatacaaagattattcacacatctaaaaatattacagtaacctgaaagataagtgaagacttctccccctaaggaatttcttgggcctgtcctaggagggctatctcctttgcaatatgttacgacaggaaatcgtccatttttgcttgtgtgtgtgtgtgacagttgtagaaaatatatactagcctaatagcggtagtgtttaaatgtctgaatcccctgttagactataaactcattcaggtctgggagtcctccttagaatagtgtctgacacattggaaatgttcaataaataattgttaaacgaatgaatgaaacaaaaggcaaatgtctagatacctatgttgtgattagaaaaagatttaaacaaatgccaaaggtactttttttcctaccaagaggtcatcatttgcatacataacattcatacacagttccaagtcagctttaaatggctggttcctctgtgtgagccactgctatggtccctggtggtagactcccacaagctgcctcctatatgcagattaagacctcagctgcttgatagttcacacagtcacctcacccaggcctcgcaggagaaaccttgggactgtgcaggagacctagggctgtgcaggaggagtttcacaaatgttttggcagcagggaaccagcagcagcagagatgaaatgactcgccactcttcggggcacaggatctagctatgtcaagcattcattttcactttattttgataaaatgtttttatggaccatgacaatgaacatggagcttggtaacaagagaaacgtaagttctgaaactcagctactcaactgatctggcctcagtttcctcctacataagatgagaataagaaggaaattgactatctaggattcgttgccaagtccaagtgagattgtggatgtgtaaacacttgtcaagccataaaacactctataatgtataaagttataaaggcatctttgtggtagaatgactgcaaatatggtaccaattatccttctaccactttttgcactgtgcctttgaagttcctactatcaacaggtgaagtctattcctcatctctgtaatctagcctggtcttggaatttgctttggttcatagaaaacagcagaagtaatcgtgtgctaaattctgacccaaggcctcaaggtaacttcctttgcaaatacatttgctctcggaacactaccactggcagaacaagcctggattagcctgattgggaagtagagatcatgcggaggagagtttagttgtcccagatgaggccatccttgtccacccttcagcagcaaacacagccaagatccagcagagctccctacctgacccatagctgatggcttgtctctcttacacttgccaagaccagtagatccatccagattcattaggaaagataggcttgattgtgtttaaaccactggagtttgggggtagtttatgtagcaataactcagcactagcctccaaccagagtccatgggggggacatgtcaaaggagaggggtaataagtagaaaatgtgtgggtcttgagaatcaatgacagctgtttcagcattacccctcagcttcctccatttccagggtgttggtggtagtcacaacttctggctcacctcgagactaaggctgagaacttctgatctcagtagaaagactgctcttaattcagagtgccatgtgaaccgctatacctctgctcccaaaatgtgattgaaaaaataagaaatggcctcctggaccttcatcaaatatctaagtatgctgtctcaatcaagagtcaaatactcagatctccttttaaatatagcctctgaaatcaacctacccagcctgacatttaaaaatcagctgataaaggcaggaagggattagttagcaaaagtgggaaagtgaatagatcagaggctagatcatcagaagcctataaaaagcataaatgcttaggacaattcgcatggaaagtgaaaagaattaaagacatgaaagggaaaccagttagtctctttatgagcaggtatatccttgctcacagaactctggctgtgtacagccttaaagctaatgtaatgctattagtaaatattgaggatgattacaggcccatggattagtggatttctgctttaagtttgctgtttattttctagggcacataacccccccacagagaatgagtaaacacagaaggacctagaattccaatcatccaaatagttcttgggattagtagatcagattcacaaaatcacaagaatttgaaggagttctacaactcctacaaatgtagtcccctcccctgtttaaacagttctagtccgtatcttctggatcccaagacttccctcttctcttaccagaatacactaatagcaaagctgctcagattatcagcagttcagcaaaatcaaaaggaatatctgagcttaagatgggtcagttacccagtaccaataaatgcagataacacttattgagcatgttaccatgtgctgagtaccatggtgtttattcattaatccaaatttgttttctcaattccatgagttaagtattaaactaattttatagacgaaacttctcaagatgcagcagcttgccccaaaagcttcatagctttcatagtttcctgcacagccaagagcaaaaccaaatctggatgataccaaactactctctccaaccatcaaacatcatgccttggctttactcaacattctttgcctttgtagtacattcctatctgccaagtactatccacatacagttgcatgcaccaagtatgtattcttagtgaacacctttgacagcttggtggagcactccactctctgaaagagcccctccttagctgatgagttttctctgggctattctttgcagcctccctccagctcttccttccgtcagatctccatttcctacactttgctccgtattgccttttatctttcccgtcttcccctcttctcaggaagaaccacaatgattgtgcttgagaactttagaatcagactggctctgagtaactgacaaaaaaacatgagatggtaactacctcatagagggtggttgagaggactctaaatgagatcatatatgtaatgggcttagcacagtataagataacatggtaaatgcttaaatataaatgtggaccttctacgaatatatcaacttggtggaagaagagagtaaaaactattcctggattcttatcactgagataaaggttttcatggtgactccattcaagaggactccattgtatttccataaagcaagtatttatttattgcctcataatgaagtactttcataaacagaatcctatgccatccttgccattaggcagcactttgtaaaagctggtacaagtgtcgcccttttgatagtcttccctgagcttccagtggaatatataggggatttgagtcaacatttgatctccttctaaagtcccttcctatattgcagaggcttacacatttccaaaactctcttgcagttagtctgatgtaatttaaagtgagccagccagacatacctgcacataatttcaaacttgagttaggtgggagaagagtcataatgattaaaaatccgttttttttccagtgcagatcacgatggagctggttggatttagtgctggcatctcgtaaggcaaatccacaattcgacaggcctctgcagattggagcagaagcagcagctccctgggcagcccagttctagggtaggacttagacatctgtctctttagctctcacaatgattatgtaaatctttaattatctataaatctttttcttccaaaattagccagagtatattctactccctgcacttgatttctaaacaatagctaagaggagctcttgcccttctttctgtacctccagtacttgttcctgctcataattcttgttacactggacattttattacagtaactcttagaaacatttatcttttcctcaagttgaaagcttgatggaaggtgctatgtcattttcacctttgatatttcccatagtgcttggcacaaagcatttgctgaattgaactgagacacgttcccacagtaacactgtggtaagctaaagcctaattttgaattgtcactaggttttattccacattttgtacattgctgaactatgcctaaacctgttttttaaaagtgaccatctttatttgtggtagattaggttcttcagaaatacgcatatgtatcctcactacttcacttccttagaagtaacatttccctgctcgactgccactgggtttgtgcatatggctggatttggctaactgtagcatagtctccaatatcttttaaggttgggcttagttatgagattcactatggccaagctaatgtcggcagatataacagactcacaaaatgctcttatgcaggtggacttgtgctctatgcctctgtcactcataagaacatgcctcagtaagttgaagaaagattcacggagccacagccactgccagccaagtccagcctaaattagctacctaatatctcctttttacctgcagattcatgagtgataaatgcttattgtctcatatcactaaagttttgtgattgtttcacagtattgtcaataagtcatgtttctagagaaataattctttcaaagaaaacttggatgtaccagaaagagaaggcataccctggtatgaagtttaatgcttccctgtaggacacttccttcctgcacaatcatcttcctcgaggttcatctccttcgtttccatagcaatacatattactcataccccagttacttactggcttgaccttacatctctttgtgccttatcaatagatgttcctcaatttttgcttctcttcattaagctttagtctcttttaaatatcattttcagggacttgtatcactctgtgaaactcctaaattctgtccaaccctgaacttgtcatagccaccaacttctagctaccaacagactgtgtctagctggcattcctcctaacatcttacataaaactctccaaaccacatccagcaatatttccttctgtttcctctttctcttaccatcttccaggccatctatacacaaaatctgttatcttcctctcaccataccagactccaaatttaataattactacgtatcttaagtgctctgacaaacattccaaaggatttaggctagtgaagcttctaatttgaaggaatactatttgaaatcattcttgtaaagcaatgagtggttttggttatgtgacttggccctgaattgattctctaatcttgggacttctccacatgtttttcttcaggtgggggcagggtgatgatgggcagcctgtggagcctcaaatatactgataaagatgtcaagcagtcatttggtagaaaggaaaggacatagggaaactggccattcctgcttcaactagaaaattaaaggctgatgtcctgtgctgttctaaaaaatcaatggctaataaatatttacctagactggcaaaacaaggattaaaatttaccatgcagaacacaacccacaaaacattttgcaactagtattgtatattttgaatggaaaaaagctatcgggtttcatataggcatttaatgaaggatctctgaagagaccctggacgtaaatctttatattgtatgctttatttactttaataaaattccagctttcctctaaatcaggctatatttctatcacattatatattgagagatgttctatcgtggatagcaatgagaattctgagtctccagggaagaagacagctagagcctctcagagctcctcaacaagctaagctaaaattgactcaatattggtgaattctagacacaaacaactaagttaaccaaatatatgtgggacttattgacaaaacaagtagccaagtcttcttccaggcacccagtgtcggtggcgcacacacattttcgcagtcaattaactacagaacctgggggatagatatgtttatttttactgcatggtatattttagctcctatactagccaaatttttagtgcaaagaattattgagtaagcttccttccctgaatctgaagctgatctttgttctgtgtccaggaagtctgagtctaaaccaaactttatccaattgaaactatcaatcctcatcagtctgtagtaactttttaaaaaaggaatgagatttttttagacatatccatttgtgtgtgagggaagtagacaaagtaacatcattagaccagtaagtaaaaaatctggaacactttttctaccttatcactagagcatcccctccacctagtagctctaccaattagattcaaacctatggtcaatattttgaatggcaatcttgaaacagcacaacacaaatgctgcatttcacaggatatataatatgaagtttatatgcatgtgtatatgtattatatgtatataatatctggggccgtgggagtgagaatctaatagagtatctgaaaccaaggcacaaaagagccgagacagtgagtacaggtcttgcaatgtgacgtgggtaggtgagaggtctggatgcaggagacagtctacatcaccaaatatcttgactgccctgcttaggaacccatgttttatagagaaggcagcaggaaagtctttacatagtggaatttgaaggagtcaatggctgtttatgcaaggcctctaacagtgaagagaagaggggcttggggtagtgacgatgctaggagtaagtgaattatgttgagaaggttcatggcagtaatctaggtgagaaaagagaagtgaggacatatgctttaaaaggcttccttttctacctggtagttcaatatataagggtccttcgaagactgaagttttcatgcgatttttgaattgtcaagcatgaaaaaatacacaaagcatatctgaactcatgtacttcaacaaacaacttcaaagtcagattagaaacttaacatttttataataaacttttaacttttgtgggcaccatagtaggtgtatataattctgggggtacataagatgttttgatacaggcatgcactgaaataagcacatcatgaaaaatgaggtatacattccctcaagcatttatctattgagttgcaaatgtcccaaccacactttttaagttatttaaaaatgtagttattgaatagtcactctattgtgcagtcataataggtctccttcattctttttattttggatccattaaccatgcccacctcccagacccccactatccttcccactctctggtaactatctttctagtctcaattgtttttgatttttagatcccacagataactgaaaacatgtgatgttagtctttcttttccttgctttatttcacttaacattacaatctccagttcatccatgtttcaaatgactggatctcattcttttatggttgactagtattccattgtgtatatgtaccatactttatctgtagatggacacttaggttgctcccaaatcttagctattgtaaacagtgtgctacaacaaacatgggagtgcagttatctcttccatatactgatatcattttaggttgacaattaaaaatctagcaccataaataggtaaagtcatgtgtcaagtagaactctgtatgtgtatttatacatatacatactcctcagcttacaatggggttacatacccatgatcccatcataaattgaaagtattggccaggaacagtggctcacgcctgtaatcccagcactttgggagtccgaggctggtggatcacaaggtcaggagattgagaccatcctggctaacacggtgaaaccccctgtcgctactaaaaataacacaaaaaattaaccaagtatagtggccggcgcctgtagtcccagctacttgggaggatgaggcaggagaatggctgaacccgggaggtggaacttgcagtgaaccgagatcatgccacctcactccagcctgggcgacagagcaagactccgtctcggcggcggggggtgggggtgggggggaatattgtaagtcaaaactattacacctaacctaccaaatatcaccacttagccaaatctaccttaaatatgctcagacttagatgattttgcccaactatagtctaagaggaagcctattttataatagtgttgcgtatctcagaatttattgaataccatacgttacatcaaaattgcaacagtttctcacattgtaaagttgaaaaatccttaggtctaagcattgtaagtcttaaagaccatatctttatctatctctccatctatagagatatagataacataatccttagtcagcttttgaccagaaaattctaaatgtgaagatatcagaaaatatcaccttaaaatgatataatttggttatccatatttgaaaaatgattttataaattctcttgataataaaaaggaaaaaatcttcccattgacttttttcttaacaaagaataaaatacataaaatatttctactaaacaaacctcaaatctctaaatgaggatacaggatttaaaatactccgtaatttggtcagaatagcatagaaagttttaacattcataaaaatgcaaatgtacattatatatacttatgtttattaaatatattaacgctttactgaagtgattttatacttaaagtttttcaaaacttagttcttaagtaactgaggacatgaagaaaaattctcttaagagatttttagatccgagtcattttccctactcaaatttgtaagaagatacacagtagaaactaatttctaagacatgatctgatagattctggtgtgtagactctaagagaaaccatgcaaaatttgttagattacacttaaaacataattctcttgagttatgtaactcataagaaaagcgaaactacaagactccagtgcattataaactgaatcaaactgagctttttttcctgtaaaaatggaagtagagccaagtgtagttacattttctttccaactctttcgtactacttggtcccttgttatttttctaagccccttgctgagcattttattagaggaaatcactcgagaagcatgtcccaagcaccaagaacagtggaacacaatagatgctcaataaatatattgtttgagtaggcaagttcccatgtgaattctctgatcatcttacacttaagaattgttaactcacatgatagacatgattagtaccaaactaaactgccacagtattctagtccacctcggtatacttcagtgtcggctcaccccaggttgtactgacaatctccattcggaattaggcaagtgatattacagttgactaaagcaagctctgctgtggcactgccaacatttgaattatccctacctacccctaaaacagtgaggcactaccatttctagaacatcctgcaaagaggggggacattttcataagaaacagcataatccaaggacagattgcaggaaaagtctgacaatgcaggtttagccatctgtagtcacaactgcaaattgactttttccttccgaactgatgatttgaccagcagaaccaaaactaaatagcaacttacaacactaactgctagatttacgcaagacagaggtagttccctcaaaggcaacattagaagagccatcaaaatgttcatctcccctaacatgtcttccttaagctgtccttatcccgaattccccacatggatcaccactcataagaagtggtggctctcggctcttcctgcacatcaaaagccagataaaaatatgatcctaggtttttactgcagaccaactcacactttcaggatgagtagtcatattctgtaaaactacaggtgggataatggacaaagaacaaaccatgatgtcttcaggaagccacaataagcatataagttgcccaaatgaagttcatgccttattttgctgaatgaatcaataaattattttctatgcatctactatgtgataacattgtgaaaacatacaaggacaatcaaccccattattaaacattcagtaccagggcttgcttcatgggtgtgcaacctgtgcagctgaacaaggccctgccctcagaagggcatgcttggtttaatgctcagctgtcagcatcttaaaactctgggtaattttgaaacaaggagccccacatttttattttgcatgagtttttgtactagccaggcttggaagggttgaaactcaaatatgaccctaatgtgacacattgtccccaccttcatctcccctgcaatctactgtatcataggggaattgtaatgcatcatccctatgcttaaaattcatcagccattttctcctatgcattgcataatttgtctgtttctctcgcctctagcttgacataatctttcccaactcccctcccaaatattgctttattatcgtaactggcaagacgggaagaaaatgtgtcataagagtatatgaaaaggggtactcatgctcaggtgccaggaaataagtcttgggaaagctgagaggctgaccttctaattttaaattggagtcagacataaaaattgactgtattggttaaatgatattggttaaaagttataaatggcttacaaaagactgcatcattccccattcagaggaagaaacaagtatatatctgaggcctccaggaggaaattgaacatggggcaccaagaatgaagaggtggtagaatataggcacaaggcatcagggatgaaagcagagagaaaatactaggaggtaggaatgctaaattcactctcattaaccctgagcatcagggatgtcttgaagatgtgcaaccagcacagtcacacaagctcctgagctgacaaggggccccatgcttggtaatgctctactgtggccatcttgaaatttttagtagtttctggaaaaggaaccccacatttacttcacatcaggctctgcaaattatgtagcctgtcccacttagcactatgtgaagtggtttacatgtactatcctatttagtccctgaaaatccataacatatcattactgtgattttttttctcttaatgaggaaacaggtatggagtggtaatgtactgtaccaaaaggcacaccacaaagatgaagccagaactttcatccaggtttttctgactgccaagccagtgtgtttttgatgacagtgataggctggctttccaagtaaagacaggagagagcaggtggctcagtcagctagactgcaggggacataaataggattagcagaggacaaggtaagaaggttgagtaaatcagatcactgtagtccctgaatgatcatagactttcctatgggacaaggggggaaacatgagtgacatattgagagttggactttaggaagtctattattgtgatagtgttaaggtattttgttaagcaaacaaaaaggcatggagaagatatctggggctcatatagtccttcaaatatgaggtaacaggatgaataataatgaaagctaatgtttatcaagcatttactctgtgccaggcactattctaagcactttggtataatgcttaaatactgtaatccccatcaaagttctgtgaggtgcaggtagtttttaaatatcctcctgttattgatggaaaaaatgaaaaggaaagcaagtttcagtaacttgttcatggtcatgcagccagtgagtggcagaggcattatttacttcagaatcagtgatttaatcttcaataagaatatttaaaagatgccctttttaacttaaagagttctaaaacatataaaaatgaaaaatattaaagaatgctattttacaaaagatccaggaggatagagtattagcagatttgagaacctatcgtaaaggaaagccatttaaatcctttggttcttggcacaaaaacagaaacgcagatcaatagaacagattggaaaactgaaatagtttttaaaattgtaacataagaccccataataaagtgttaggaggaattaattagaaaaacttgataatactttgaggaaatgatcaggttagattcatactttgcatgatacactaaaataacttctacatggattaaggatttaaatacaaaaaattgaatgacagtaaagccagcaggagatggaatagaatatcaggtttataagaaaacagtaacttcagctttgaagcagtggaataaattatgaaggaaaagattgacagatttgaatacataaaaaatttaaaacttgctgttttttcatcgtacagaagactaaatacaaaggatattattactgaaggccatatttgcattccatgctacaaagacagctttaaaacccaaaccatgttacccttattcaaatttataaggaaaaacatcagatctcaaaatataaatacttaaaatatgaaaaaaatgaatacactgacaatcagtaaagagaaattgttcagcctaccaacaattaataaatatgtgcaaaataaacttgagataggattttttaccttctaaataactccccataccccccccccccttatccttataacacccaatgttagttagattgaagcttgtgtactcattccttactgctggcattgcaaatgtatacagacttcttaaaaattagtaatacaaagctaatcaggctcaaagctgcatgagttttttcaggcagcaattacattttgagcactttatcgtctggaaataatagcaaaagcagatgtgagcaaaagatgttcatctgttattgtttacaatagcaaaaccctggaaacctaaatgccccaaattgagaatggttttataaattatgagaagggactacttgttatagagggcaagccatttgaagatttttattttcaggagtttggtccaaagggatgaggaaagagacagtgaagtagcttgaggggaaaacattaaggaaaaattgtcatttatttcattgaagccttggacatatttatcaattgagggggaacaagatattagaggaaataagaatgaaattttgagaaggagaagagggggagagagaaggggtggggagggggaggagaggcggagaaggaagagtggcgagactggaggtgcaaagacctctgaggcacaaagaagcctcaaaggcaaatgtggaaaagtttgctttggagaagggatgtgacttcctctgagataaagatgaagaaagaaacatttgaagtgaagagaaggaacaatttgatctctgagaatttgacttaggtgagtctttcttggtctggcagaaccggataccctgacacctgtgatgctgtaactctataacattttcacagcatttgttcactccgcatttagtgtgtcattttccagctgtgaacgaaaacatgagcaaaagtgccaccagggggcaggctgggcactggcaaaagcacttcaaagagaccatggaaaaagtcttttcctttcagcccaggggtctattctttgtttttgcaacaacaaactgcatcaagtccagagcattttccttaatggttgtgttgtgggtatggattttgctccatgaactcaagtgtgcaagaaatgtcacagtactgtactttattttctctaaataaaattaaattcaactgcaagccaccatcctaggcaaggctgaaagtcactcagtcattattacagctcccacagccccaaagcattctgtagagatgaggatcttattcagtgctcgtatttaggtcatcggtccatccagcgactagtgaaatacttatgacctgaaccaacatgatgtcttggtacatggtgacagtgctgtatccttatctgttaggataggggcagaagttccaatgtctggaacgtatgcacacacgcacacacacacacccagatacctccttaggttacgcaaagagggaagctgaggatgattcctatctgtagaaattgtctcctgtaccctcttctggcttgagggaaattcctcctgcttcccccctgtgcctgcctctttgtctcctctatggtctaatcatgggccagcttaggctacaaagaacatctaggaagatagacatcttcagaacacacaaacttcaggagaggcattgaagcccagaggccccatctagttcttggaatccggaaaggagaaaacacaagatcaaaatgcacccacacccatatgtctaaactgtgttgccacatttgccacaaggtcaccgtccttaaaacacccactacttgacagatctgacagtatgagaccgttatcttctagtagatgagagagctcaagcatccctcagtcgatagtgggccaatcccagaactgctgccatggaggagcaaagatgaagggacaaactctcatctcaaggagcttccagtgacacacaggtaatcaaggactgacgaatttaggtaagatattacacatttctaaatcacttaccaatattgaaaacattaaaaacaaagggttcacgtaatcatctgtgtattatctagcttctcttaaaaataagacccggcaaccctggcctgcattcctgcatggcagtcatgattaggagctgagtagaggttgttccctttagctgggaccaatatacttcagtgtatcacagtccccatcactccctactatgttatgctcaggctcctctcatttatgctacttgtctagcttctatacgtacttgggtttgcaactcgactgagtaaaccaaataaaatcagagacacagtggtaagtggcctataagcattaattaagcttctgcctttcctcgatgttcactctgatatacttgggaattcagaattatttcacgtagaccttacacgaacagacgctaaagaaacagacttaaatgataaacttggctcatgtgcaaatgttacacagaaagccagtggcactccgtacagagaatagtatactcatgcctcatgtatgtgtgcagaacaatagatgttcatgaaatgcagatttagctgtgttccttggcctcatctcccatgactgtcatcgagggtgcccagtggatcagtaggtcacaagtgaacaagtgtttactgttagctgtgggtggccactcccacaaaaattcctgagaactggtctcatcctaacctcaggcccatgagctcagagaactggtctcatcctgacctcaggcccgtgagctcagcctcagcctgcagaaatgccagcttcattctttattttaattttcaagagataggctaaactcagaacttatgccacaataaattagaacaatccaacagaaacaagagaagagaggctgttaagctcaaggaaagaaaaaaaaatttataatgaggacatctgtacttatctggcttttctggagagttcaagttactatccacaaaacacatctatgaaaatgtttagaccacaaaacaatatattaatcagcaaataagcaaagtaataacaaattttatgcgttgaaagatgctattaaatacaaaggaaaactcatcatgaacttcccgttaaacatgcgcatacaacaagaattttattggaactttttgttggttggaattgtataaatccagtggagtatatttagaaagacaataattaactagaaaagagattgagcataaaagcgagaaaagcactgagtattccctgcccttcagctgaaggaacactccagcttcttcagctgattgctgaagctggccataattatcagaagtacctaagtggcttcttgacccttagttgcagaatggcataagaacaaaactgataaccattagaatgcatgacaaattgtacataatatctctacctgacagaatacttaaaacaacattttatcttaggttttaatggtttggggaaagagcatacggtatctacaaaattcaggacattcattagttaagcattcttgaaatctacaatgccagccactatccaagtaaggggagcctcttaagtcacatttagagctattttctttaaaaggcactttgatattagactctttaaacataaattttaaagtacagcttgaaagcgagtgataactactaggaaacaggatttttgaaggatatactataaattctgtagcataaggtttaaaaaagaacctcatctttgaacattttttaaagtgctgcacctttaaagacacaggtgcttttagttcacagtccaaaaatgagtgactgaatatactaatgtcaaagacaatgacaaaatcagagttctgaaaaatacacagctttcaattaatttgtgaacatgtgtgcatgtgtgtatgcatatctacaagtccctaagagatcaggagacgttatacacaggattgctgttatttctagccgctcctaagtccagatattagacatgcaaaaagacattcaggaaataaatggggcaaggaaagagatactgaagccctccctaaaatccaaagcagcagcctgtgtagatgtcttcactgtgaggtttccacggaagcacatcaccctactcagattatgcagtctcatcttcaagtgccgttaatcagaaacctgccagggagaatactaaactctttctaaagatatctggaatatcatcaagttttatcaccaaacaataaaacaaacccgtcaagtagattttaagatttatttctcctctactattaaggagaaaggagcctgttataaatgactaacattagtcacaaatctgcaggtcagcaaatggaaaaaattgaaataaccatacatgaatacgaaaagacagcttgttaattacttttaagaacgtaaattgtgttggcatagtgtacttatttatgaaatattgacaaaataagaaatattctacatcagaatactgagtaatgatggggcaaaacaaactagtggaattttcaattacattctctggggtctaacatttcccatcttatctttgcattctatcctcaactttctcatcctcaatatctgaccactataaggcagcttcagaagaagcaaagatacaaacttatttcaggaagttactttagaaagcaaagtgtatagggctgggtgcggtggctcatgtctgtaatccaagcactttggggggctgaggtgggtgaatcatgaggtcaggagtttgagaccagcctggccaacatggtgaaaccccatctctactaaaaatacaaaacattatcagggcatagtggtgagcagctgtaatcccagcaacttgggaggctgaggcaggagaatcggttgaacccaggaggtggaggttgcagtgagccaagattgtgccactgcactccagcccaggtgacagagtgagactctgtcttaacaaaacaaaagcgaagtgtaactctaccacaatgcccgaagctttcagggaaacctaggaagcctattgaagatcactaggaaccaccactagcaatgcgtctaaacttaaaaccaatgcagatactgtgtgttaggaaggaggggagagatagggaggaatgacatattggacacaatacctgggaacacatcatgagaaaatagtttgcaaactaattaattattgtataatcatgatccttagagtggtacaataagaaaagattaaaacattttaatatttaaaaccttaaaattcatccttataaaaactttgttgttaaatctacatgctatatttctaaggtaatacatgtagataatttttaaatggtaaaaacgtaccatattgggattaatgcttatttttttctggcccttgggggaatacatggttaaaacctggataactttttgtctagataaagcactcaaggaaatctggcttcattggatcaattactccactaaggtatctttttaatgttatcttattttcacaaacatacattatagaaaattttcaaattgcagagaaatataaaagaaatcgcctgcaactttatctctaaaaatattttggcacctcttatgcacccttaaaacatagtattttacatgtacttaagtatacttaagcataaaatttcgatattaatatactacagtggctgttttaaacccctttttaatatgaattattttgaaacacaatcttgtctggacactacaaatttgtttataagttatgtactaaaatttagccagctctttatagttgaatagtttcttctgaaatatttgctattttaaaataatgcctatgaatgtcttagtagcttctcctccatatttctataacttaatacatttttagaaaaggaattgctgaaagataagatatttgatatgttttataatgttgcttttcagaaaaatggtacaaaatttacccatgaatagcttacaggaatctcctgacgctcaccaacagtagacatcaacattaaaaactacagtgatttgtcaatttgattagtgaaagatatccagtacccaatttccagtgtttcctaactcctctggcccaatttactcagacatggagagctttggatgccaaagagacaagattcgattggtaagatatggtaagattttatcctgtgagacagtggttctcaaggaaatggtacaacattcctagggaatacctaggaaatttgggtaaatgtttcagattttcatgattttgagagggttgctactggcatttagtaggtggaaaccagaggtgtcagctgccctgcactgtgtagagcaatcttgagtgacattgaactgtgtcccatgttttacacaactttcaaatgtcctagtagaaatgtatgaggtaagaagcttggttataattattcaagcgcagaacctaactgtttaacataccaatgccaaatattttgtggccatttttaatagttttctactaccatgtaaagcaagggaaaaatgatttcttcagagtattcgcaaaagttcataatttttgaaaagtatatcattaataccacactgttgctgttttcatcactaacatcacctacttataatagtctgcattcatagactacattcactgtgtttctaagagtatatgcaagaatcttatcacttccttatgtattccaatactgtcatgctcaagtatttatataataaaacttttcttataaactttctctttcatattgtatataaagtcttatgttgccttttacaaaactgtatagggaggtcatgtatttcattggtttcattttaggagagtaaagggtatattattctcctaaatattatatttactataaatagtggtcattgactctgaccgggttgagaactgttgctatatgggactagggaacaggaagcaagtcagagacttccagcagaagagtgacatgaagaagcagagacggaggtaaagaggggcttgacggtaaagaaaataaactggaaaaggagatggcaggaggcagagagaccagaaaagagacaaatacaatctaggtagggaagtaatgaagacctaagatatcataatgagtgagagtcagaggaggattttacggagggcgtcttgaaaaagtgaagtcgttggaactcaggcatccagtatcacagtgtcattgcattgttaggctacagtgattgtgttctcaaatagtctcacgtacgtgcacatacttgcaagcatacatatgcgctcatacccttcaactctccagattcattaccaaataatccctctccccttctgccgccaaatggaagatttatcgcaccagcgattctgaaatgtgacagctcaacctgacgttagtctgaatcagaggggcaaagccttatttgatttgtgattctctatccaagataaaccctgaaataaatttcaagtgtgctttaagtacactacaggttataaatcatatacttgtattctcattctacagtaagcataaaacctcataaactatgtgatatataatctcccttcccccttgccaaattcatgcacacttcctgacttgcagggagagaatgataggaaattaagaaactcagaaccagtgataatttgtctgcagcatgcattttttctattcagtagcaactataacaaatgaagttgttactagatcaggcaaggggaaaccatggttgtaaatggcagaaaagcatttccaaaattaagggatggagagtccaagatggctgacagtaaaaaaaataaactggatatttactgtatgatcatccattttggcaaatattggggataagagaatgtcccaattcctgttcaattcccaattaagataaaaagtgcactacaggctgggtgcggtggctcacgcctgtaatcccaacaatttgggaggccgaggcaggtggatcacctgaggtcaaagcctggccaacatggtgaaaccccatctcgacaaaaatacaaaaattcagctaagcatgatggtgggtgcctgtgatcacagctactcgggagactagggatgtgggaatcgcttgaacccgagaggcggaggttgcagtgagcagagatcgtgccattgcaccccagcctgggcgacagcaagactccgtcttggaaaaaaaaaatgcattatattctgtatttgagattagcttatatatccatactcaatttcaatttctctaaaaacaaacatgagtctgtctagttattctaatccctgtcagtccaacagtactgagttagacacaaatatcacattcttcattgtttttcgtaaacaatttctagcttagtgagaaaaatggtgaccctatctttctcaacttgtaatttctttctctaccctactaaaaaatgtcagccacatcccatcatagtgaaaaaatgttcctctaaacttcaccactaaattctcacattgtccagttcctgtttctctttatgggttacttaacatctgaaatgtattcttaagcactttgctattttgtgtgtgacaaatacaagacaaatccccaaagtctatgctacctgcctgaaatggataagggcacagatataacaccatccatctctccacatctttgctccctgagagggtttgataagaggtgtattctgtattggtcatctattatgttacaggttaggaggtttgagccatgaataaacagaaaatgacctgaagctaaaaggacacgctgccaagtgaggcaatcagtgaccatgacttaaaggctatgttctgccctcttccttctagttagactggggcaaaaatcccaagctttctgccgtggaaggcaaggctcccatgaccctccctctgcctgttactcttctcacctcccatcactgcttctttgcacccctgtggtctttgaatcacattctcccctcttgagcctctgagttctcatgctgtgattcttcctggaatctgcttctttaaaattgtcccctgactgacatctgcttattgttaaaaactcagctctagtatcacacattggggtagataccctttctctctactttcactgcaaacagttaatctccattcaggtacttcttggttaccttgtgattgtctctttactcattgtctctaggaatattgagtttctcaagggcagagacacgtccttttgatgtttgtatttccagtgcatagtatagtggacactcagcaaatgtttgttgcttacctgagtagggagtcttttgttttttgtcttctaaggggaaaataggctatggacaatgaaaattgcttttaaaaaaaaaacgttttccccctgagggtaaggagaggggtttgcaagtcagagcttttactaaccagggtcataaagtcagctgtgctgacttgatcccactcaagaggtagggaattgcctgattttaatggtgctagcccataagaacttggactctacatgtcatggccacataatccccagtgaaactcccatgggttcactttcagtatgcattatgttcatgcatccagaaagtgggatcaagtagtgttactcacgagactccatagtgcttggaaatctggattagaggcaggattataactggcagggccatgctaggcgaggagtagatgagacacaagcagtccctggagcctggggcctctcctcacacggtatcatcagccccaacagctgtgtgtgaagacacttccaagcacattttgttcgatgatcagctgaaacccactgcttagcatctcttttcttttatgtaatccccttgggtgtaagacatagggcctttgttgaagacagtctcacgcttacaaaaagtatcagatttagacttctaacattatttccaagtaaggtggtacaacagtcagagatgcagtagcagagttgaaataaatagtcattcatcacacaactttaaccttgtgtcccatgaccagatgtcacttcctgaagtacactgtgagccagaacttctaccttacagacaacctaattgttttgggtgtgtgtcaaccatgttaatttgttaaatgtaaacaatgtctacaactgtttggcctgtcattactttttaacaaactagaagacacttctctagataattctgtgcttgctaggccctcttatttataggatcaacagataatgtacactgaatctacttcatcaaaaagaaaaataccatttacttattacttaccaaattaagttttgcccagaactcgggtccttcttccatctctctgaggctcggtggaatgtaccaaaagcaaatattggcatattcaggctgagaattagaaaaaatataaagttgttatcttaagatttatcttagaatgcaatgaaatacttttaaaactcttagctagtttcttcaagagttatcatgtgtataaaattttaacatcagaatcttatagagtaacaatcccttctgccttcttgataacatcctatttaaaaattttctactccatagcgtgcacctagcaggttctctttcatcttaaatgtgcaaagatcaggaaaaaacagtaaagtttgaagctgactcaacccagctctgatcgtcagttagtgcctgcttacatacatgctcagagatgccctggatcctctctctccaacactgatccttaagttatttgctataccatcataggcttccaataattcttcttaaggcagccaaagttggcccctacacctggcaaatgcaaaagctttgattacctgtgagatgataacagcgtgacctgcttgggcttcactaaccagcactactatgaccctagccaatactgcttttgaaaaaagaacatcaccttgactcccggctctcgaatatcagtaaaagtgcgaattagctaggggacctattcaaaatgtagattctcataggaactcaggttcctatgttcaaaatgtccaatgtctaagtccatcctagaaaaggctaaagaattggcattttatgaagcatgtcaagtgattctgaagcgggcagtttatgttctatcagaaactctcatctacactaagtaatcataacccagttatcttccctgccagtctgtttttctatcagacatgacttgcttaaacatgggactgtattgtaacaggctttagcccagcctttgtcacgcagacaaggctttgtcctcactggacaaaaacataggaaatgcgatgactactcaatgactaggagatctgggacattatgttgggggttcacaaattagacatatagaattgtattcaggaaagattgtgtcatatgcatcttcctcatttgatgcttcacactgacaatatttgaactgattttcattttctgccataaacagtttgtaataaccaatgttgcaacagttctcaataactgtcagaattatgctccagtatataaagtttcaaagcatttcatcaagaggaaagacccatcatctcatatcttaataaaaagtagtttaaaatgaaacactgtaattcaactcaattttcacaaacatctattgagactacagtcattcttacaaatctacacaatttatacctggatctctgaagtattgaaagtaatggcaaaaaccacaatgacttttgcagcaacctaatataatagatttatctaggatagactgtactgaactcccaaattctttgagcatttaatgtgaacacatttttcaaatgaagtaactatacctgactagaaagtagaagaaaaatatagtaattatctgtcactagattgtgttatgtcagttatcaatttattgcctctcagccagaaatctaccctttttgagtgtcctaaaataatgtaggtggactctgcagatatttctcccatgacatgtggtccaatcttagactttgtcagcagagggtgctggagagacactggagaaggaaggaatgctttcctggtgtggtgtgctcactttcatgggtctcctacagaatctgtggttcatttcagcagtactggtgaccagaaacataagtacacccccacccatctaccccagtagcttcccccagtacacccctttcaggtggcatcacgtggcatcacagcagacaggcagcaagtggagagcccataaatggcttttcctggcatactcccctcaggtggtttcaaaggagagagatgccagctaggcaccttgccttggatgacttctctggcactccttctaggtagcttgcagtgatttccaagttgtggcatggcccctgtagatggcttccctcagctcagcactccagactagatttctagtgagtaccaccaatgtaacatctcagtaaacttttctgctatcccatgagccaaggtcatactctctctgaagaggtctagacctcagtcctgggaagggatggactctcccttgggcgctctatctcagtgccaggtgtggtggctgctctctatatcagctactcctgttcatttttaggtttttcattctctatgaggcaatcctccattactccaatcccttgctaataattattgatattacactttcccactttaccatgcagttcttgtcttctgagtggactctaatatgtcaccaaatttgttattccctttcatttgcataggaacattacaaaacagtttacgatgttttatctattatgggttctatattttacaagttaggacttagatctgattccttttgcccaaacagaaacttactaaaaaatgcaaaaggtctatcactaagcacttttagaatggaatggcttcagtgctacaacatttgaaagcttataaagcccttctgacacttcacttcattggaagaaatttgatgtttcatttggaatatctttgctttggtcatttccaaaattaagagttgaaaaagtctttgaatttttgcaaaaatatatttgactttttcctgtctctgcctctgtagcttgtattttacataattcttaaagagacttcaaagcactaatgagtattttcagagtaaatcatttgtataccccttaattttaattgcctacatatgtgaaagtctgacttcttgggtgtcctgagaacacatttagtctatgttctaaaatccacaaaattaggaaggtatttacaggagtccaagtatctagtgaagggtacaaaaactctggagcagcaagtgcattgtcataatctttaaaaaattcatgataaaggagtaatgtgccattaaagaatgaatacattctataccggttttcaaacaaaaaacattctaaagttctttatcaatttcaggaagaattatttagcaaattttgagaccatttgggaaagaaattagtggtcactaaggtagcagctcacgttctctaaaactgagttatgtcaaaagaaattcatctcctttgctttacaatgtcattagatcagaataataggtaacaaaagctaaagctagcactattctgttttaataaatgtaaatgcagaatccagcacacagattcaaacaatcatgcaaatatagagtgaaggaaaagctggaatggtgaattttaattgacttcaagcttataggtgttaagattagactattgaaaaatttcaaaggcagcactggatagcaaaaaagcctaagttttggagttgcaaggatgtggctttgaatttcaacttcatcagatctttgggatgagtatcaaactttctgtttctgcttcctaaactataaaatgtagatgatgtctgccccacagggttggtttgatgattaaagagaaaacgtgttttcaaaatttagtaccgtgtctggcacacagcaagcactggtcagttagtgactattatttggggccataatggcaaaaagagatgtcttttaaagtggatgagtagctccattaaaatgtgcactagtgaggtacatcactatgttaatttcttggtactatatttgaagggaaacattaagaaataatgtccagcgaggggtaaccaagctgttcaaattaataagcaaagctttctatgttatagatattgactaggcatcaggacaagaaaatgacactttctgaacttggaatgaatagaggacagggtgtactgaagagaggtgaagctagaaacgaagatgggagtcatgtcatgaaggacttctcgtatgatgtacttggaagcttgggcttgattctagaggaacatggagtcactggagagtttcactataggaaatagatctcatctttgaaaagctgctctagcagcagtgtggcagttaggctggagggatctaagactggaagtgggacacaagttagcagacagtacctagatagtaccaacctgaagagtgatgagatcttgaactaaggcagtggctttgggagtggagaagactaagcattcaagatatacttagcggggaagaaaaggagatagtaaaaacatcaagatttttggttagtggatcatagttctaatgaccaaaagaagaaagtagaattttggtaaggaaaatactacacttaagtttttagaaatgttgaatttgaggtgtctgtggcatctaggtgaaaatttcaggaaatattcatatacaaaggcctggagtttaggagctaagttgaggatgaagacatacaaagaggctattgataacaaagttctgaatgtgaagacatttcagggagactgtggccaaagacaaagtgttagaagaatatttaagggagtgccctgatgaaaagtcccttacatggagactgaaaagaacaagtcacatggaaaagagaaattgggaaaggaaatcaaagaaactaagacaggggagactatcaagagatggagtgatgaatgggtaacatacaatgctacagaatttcagcaagatgaagattaaaataatgtgctttggatttagcaattaggaggtagttatatagttttattagattacaagataacaatgtaagaaaaatcacaatgtgcttgatacatattagtaggttcactattagaacatgaataattagagctatctggaagaggaatgaactagtgaattctctgcaaataggaagtattcaatcacaggttgaccacctgttaacagatacattaagacaggtttgctgcattgtgcaggaagttgactatatgtcctcgaagatcttctataactcagttgatgaaacattaataactcctcctagtgtagaccttgagaaaagaaaaagttgaataattaggactctcccaagagataaaaaataaaatatgtgaattgacagtgtaagaatgaatatacctctaggaaaacatctattagatcttagatccaacacagaaaaatagagatgattttcaggggcctatgaataattcagaattcacttaaaataatacatttcttgaagatgattgaaagttatttttattctttccaggaaaaaatactcaagtactgggtattgtcttgttatgttcacttacaatttccaatgttccactttctccttgctgttagacaacagtgacacatactctctcaaatacatgtacatatacatatatagacatacaaatgcatataagcaaaaagactatcaactttatatgtgacattcagggtctaattctgctttattctcagtgtaataaaaagaaaagcggcaaatgcagatcacatacaaaaatccttacaccaggaattctggaaaaccatttagaaaaccacctgcactgcttgtgggccagctggctcccacagatgaaaaaatccaggggcagaaggctgactaaaatcccaccttagctttcattgcaaggacatgagtgtttgcaatttcctaatgacgatggtaagtggtttttcttttctaagactttaggaagaatatataaagaactttttaatcggcccatcttttttctcatcacttccagctctgtcaaaagactgtacagtttcaaggtgtataggacttttcataagcactatagctcccaacaccagagaaaataacacaactcaaattgagaaaatagaggaaactcaaacccgagaaaatataaagtgatcaaactcaattcaaataggactgctgtttctcccatacatgcttagctatccaccactaaaaactatagacattttcttacatgtttataatgccattatgcctcacaaaattgacaattccttgacaccatctaatagccagttcatattcaaaactccccaactgttacaagaattactttttacagttggcttgttcaaactgggatttcaacaaggtccatatgccttatttggttatgcctcttcggtctctttgaacctaaagagattatcactactccctctgttttcctcacatcaccggcctgttgaaagaaaccaggttgttctgcagaacttctcgcactctaaatttgttgtctttatagtactaccagaaagttgtttaatttttaatcattttggtatgcatgcaagatcttccatatgtctagctttctagcactttggaagcttagaactttctagtctgatgcttcctttgtagatactaggggaatccatgctctagattctctggaaagtatttcccaaacttccctgaggactattgtcatatttcactttggctactaaaaacagtttccaagtttgtcttgcttatttttctcttgtcctcttcactattgctttttcaacattcctctcttctcatgacatcaagaataatcttttaacatgcaagtcagactcctgtcttcttaaaacatctccagtgactacattcgggatacaggctaaaggcctcaccttgacttacctgaccaccacctgctctggtctctgcccacctctgcaattccatcacctgctgcacactccccttcattcaatacaactttttttggctgctcaaagacagaactctcttcagctttaagccttgcagttgtttaccaattctgccagaatatctgtccctcaaacatccgcatggcttgctgtttatctttattcaggtctcagctcaaagataaccttaaaatcccctacccagattactcaaaccaaataagccgtccccatttcagcattctacacttttccccccagtacagtactatatctataacctgtctaattatttgtatactagattatctcatgaacatgttttattgttttaagactacctgatttccctgttaattaatttgcttaattagtgcctttcagtttccacttgaatgtaaacatgaaattgggggaccttttctgttttctatctcctgtgcctagaaccatgcatgacatagtaattgttcaatgcatcttattgaataaataccaaaaaagctagatttctttttctttttttttttttccccccgagacagagtttcactcttgttgcccaggctggagtgcaatggcgcgatagctcaccgcaaccaccgcctcccaggtttaagcaattctcctgcctcagcctcccgagtagctgggattacaagcatgagccaccacgctcgactaatttttgtatttttagtagagacagggtttcaccatgttaggctggtctcgaactcctcaccttgtgatgcctgccttggcctctcaaagtgctggaattacaggcgtgagccactgtgcctagccagctacatttcttatgtatagcacaggttccaagactggaatctctaggttatttttacattaggttaaaaactgctataatacatatactataacaaaatctaagaagtttgcaatttatatttcttaaaaaccagaattacacattaaatatttatattttctaaacatgttttagaaaaaaatattctctacatttgtaaccacctaatttcttacacatagcaaacaatccaacatcagcaaaatgacttattttcccattgctccaaagctaatatgctcattattttataaaaagagaaaactgtatgcagtactgtacattcacttaattgatttttcacatgcaggcaccactacatcacagatgaatatttgcagtacaatcatgcaatttatataccaagatagaggtcataatttattcaatattatccttggtaattattattgagcattttaattttcaatacttaaaggcaagtatattctgtgaatccaacaaaggaaaagtactcactaatagagtaaattaacataatagactatgaattaagctaatgacttgtttttaactctgcaacacaaaaaccaatgaaacatataacagataagaaaattaccaccttcatcactgttaactgacaaaatcacaagcacaattatgcaatcacttacttccatcagtaacttgaatccttctcttttcttgatttcatctactaggtacctaaaattaaaagtcacaataatatttataatctgcaatgtaaaagtgtcatgaacatgactgatatgacaaaactgattcagacagggcttggagataagaaagatacagataaaggtcaaggaacaggcagagctatggatagataaatactccagacctactgtaatttccttggcctgagtaaaaggatgcatctttttgatgatgatatctatctcacatgttagcatcaggctttaaccctggtgtgaaaagccagataaagcaggctggatatatatctctgaacatgtgggtcttacattcatactgtaaatgggggatttaaccataggtacttacattaaatagctggcttggaggaaagagttttttgttttgttttgttttgtttttggtgtctaatcctgcttgtaagttcacttaaaatcaagaaagatcaacataatcttttctaagtccagcacagagaggaggactgataatcagtatcatgttaaaagtaggctgattatcctcagcaaactaacacagaaacagaaaaccaaacactgcatgttcttgcttataagtgggagctgaacagtgagaacacatggacacagggaggggagcaacacacactagggcctgtcaggggaggatgaggggagagtattagggaaaagagctaatgcatgtggggcttaatacctgggtggtgggttaagtgcagccaaccgtggtacatgtttacctaggtaacctgcacatcctgcgcatgtaccccaaaacttaaaaaatacaagaaaaaaaattacctgaatatgaggggaaaaaagtgggctgtagccattgatataatatctataaagtcattttgaatgttgggggaaagagaattgtcacacctaagtaaagggcatagatgaaatatggaatatgagtgagaaaagactaaaacaacattgagaacatggtgccctatataatattgactcctctcttctaggcttggcttttgtctgtaccaaaagagaagtctgaaatggctggccttgaaaactagtgattcacgagcctttgaaatattcacaacacttgacccagtacttcaaatctaggactcaaacataaggaaataatagagacgctgacagaaatgtgtttgtcagagcatttattgtgatttttatatataatagcaaaaaatcacaccgaacatcaggaatgcctttgaaaactagattccagtaatagttatgatcctatgatcatgtcactaaatcataaatattcaactaatatttaaagacacaaccatgctcctcttgggcctcaagtctcttacctgtaaaactggactaatacaatcttcttcaatttgaaatggttttttaaaataataaacataaatgcagactataaaaactggaaagggattattacgtcattttaggaaggccattctataatgtgaatatggaatacactagtttttaagatgttcctttttgcaaatttatacagctttttatattaaaatattgatgtttgtatatttcaaagatattatctatatgcaattgtattaaaaattgtcaatattaactagtaatatgggaatccttgagcgataacgtgagcatacacatgggcacgtatgctcacaaagtaccagatgttctacatatgccattctctgaacactttttcagaagacatgtagctataaagtttttaaaccatctatcacactggctagctttcataaaaagcaattccattgctcaacagatatcagaaaagttattcaaaatcagtaataatcaaagaagtgcaaattaaaacaatataggcatccctcgggggtattgtaggtttggttccagaacactacaataaagtgaatgctgcaggaaagttcctcagtgtatataaaggttacatttacagtatactgtagtctgagtttacaatggcattatgtctaaaacacaatgcacatgccgtgactaaaaataccttattgctaaaaagcgctaaggattatctgagacttcagtgagttgtaatctttttgctgctggagggtcttgccttgatgttggttgctgactgatcaaaaggctgaaggtcggggtggctgggacaatttcttacaataaggcaacaatgaagtttgccacattgcctgactctgctttcacaaaagatttctctgtagtaggcaatgctgtttgaaagcatcttacccacaacagaacttctttcaaaattagtcaatcctttcaaaccttgctgctgctttgccaactaagtttatgtaatattctatatcctttgttatcctttcaacaatattcacaacatgctcactgagtagatttcttctcatgaaaccactttctttgctcatccataggaagaggctcctcatccattcaagttttatcatgagactgcagcaattcagtcacatctttgggcttcatttctaattctatttctcttgctgttttcaccacatcttcagtgacttccttccctgaagtcttatacccctaaaagtcaaccatgagagttggaattaacttattctaaatccccattattagtattttgagctcctatgagtcatcagtgttttcagtggtgtataaaagggtaaacccataaaattttcaattcactttgcccagatctatcagaggaatcactgatatcacggctatagccttacaaaacacatttcttaaataagacttgaaagtctaaattactccttgatccatgagctgtaaaatgaatgttgtgttagcaagcatggaaacaatattaatctccttgtacatctccatcagagctcttgagttactaggtgcgttgtcaatgagcagtaatattttgaaaagaatctttttttctgagcagtaagtctcaagtctcaacagtgggcttcaaatattcagtaaaccatgccataaagagatgtgctgtcacaggctttgttccacttagagtacaggcagagtaagtttagcgtaaatctgaagagtcttagaattttcagaatggtaaatgagcattgacttcaacctaaagtcaccagctgcattagctcctaacaatagattcagcctgtctttgaagctttgaagacgggcattgacttccctctggtcatgaaactcataggtggcagcttcttccaatataagactgatttgcctacattgaaaacctgtttaatgtagccacattcttcagtgatcttagctagatcttcagcataacttgctcagtttctccatgagcatttgctgcttcaacttgcacttttatgttatgagacagcttctgcactcgaacctcatgaaccaacctctgctagcttccaactttccttattcatcttccacacctctctcagccttcatagaactggagaaagttagggtcttgctctgaattgggctttggcttaaggcaatgtcatgcctgctttgatctatccagaactctacaaccttcatagcagcaataaagttgtttcgctttcttattattcatgtattcactaaagtagaacctctaatttccctcaagaacttttcctttgcattcataacttggctatttggcaaaagaggcctaactttgtctgtcttggcttttggcatgccatcctcactaagctttaaccatttctagattatttgaagtgacagacatgtgactcttcctttcatttgaacactcaggccattgtagagttattagttggcctaattttgatattgctgtgtctcaggaaattggaaagcctgaagaggagagagatgggaatggccagttggacagcagtcagaacacactcaatattaagttttccagcttctatgggtgcattctatggagccccagaacaatttacaacagtaacatcaaacagaactgatgactcaaacatttttattatgagaattaccaaaacataacacagacatatgaagtgagcacatgctgttgggaaaatggcacttgatagacttgctccatgcaggattaccacaagccctcaatttgtaaaaacaacaaaacccccaaaacacaatatctggaaaataaggttaagcacataaaatgaagtatttcctgtattaaccatgtttcccaatgataccagaaataaattttagagtgacaacatccagtggtggtaagaatatgatagaaagttgctataaaccttttaagtaatactcatatcttatcaagcaaaccagttttgaaatgctggtctacaaagaaaaaagttatcaatatcaaggatagatataacagcatatatgtgcacatatatttatatgtactatctaaatgtctgtactgtgggtatataggtatattccatacaaaataactagaaacaagattaatattcataagtagggaattaaaatgcggactatagcaacataatgtaatatgcagctattaaaatgaatgaattatatccacttaaagcacaggatgatcatgataaattagtaaaagataaaagtgaggttctgagaaatggggatgatttgattcaatttttacactttttttttttaaatctcta

SEQ ID NO: 1652 - DNA, 11270 bp, Homo sapiens
gctctaattgagtcaaggggattaagacatttcaagttgtatcaatccatttctagttggattagataagcatgaaccaggcaagctggctctgatcagctagaatgagacaaattgaattctaaacagtttaattggaatcaagctttatcaatctaagttaatttctgtgctgcctgggaaacaaaacattgctttaagaactggtgtcactccatgcttgtgtcatggtggcaaaaacgatgagttgcttgccagtgtccattctcatagttttcttcactactagtggaactacttatgtggttgtggtcatcaatgtgtctagctaaaacaaagcaaaaaacaaacaaaaacctacattttctcatctctcctgaagagaaatatggcaaatggagtgggcattgaaaaataagttcttttctatttcttgtgcctgaattgtggaaaaaaatggctggaactacagagttgcaaccatgggtaaaacatggtgacttaattcatctctaaggatggcacaataaaaatatataaggatcctgggtaacatggtaaaggtaccatctcctgtttccaaagtggtcagtgctccttccaaatctcctaggcactcaccagtcctgctgaagactttaccttcaagcatctgtactctctgtccaaaggattactagggccatagggggagcatggtgggggactgtcagggagctaatgcccctgggatcagtttcaaccaatttatcaaccaatggattaacacctgttcttccccagccctcagatgggacatctccaaggtatattttataccctttcgccgatgtcatgggtaggatcaagcctcagttgctcagagcattaatttgctcactaataatcactactgattctcttccctttcctgtctcactgtaccactcccaaaacagtgtttcctggcatcaccaaatgaataggatacttgctctcaaatccttgtctcatgcctgcctatgaggtaaccaaatataagaccatctctggattgtctatcttggaacttcttttgaataaagaaacataagcctctttaatcaaatcacaattatttgagtattctgtaatatgctgctaaaccctttcttatctgatctgattagcaatgtaataatttcttaagcttaaatctctttattattagtagtcctttttccaatgaagaaaaactattaaaaaccaaaagccagaagaagaatttaaaagccttttgatttaataaaatctgatgcctactaaaataaatattgaaaattatattctaaatgtttacttttagcaaatacaatttcaacaagtaaatggctttacattgccaactagtaaatttcagttcttacttgactcatccatagcttttgatagagttggtcctttcctcctttctgaaaaatgtttctctaattggtctgtaggcaaccaccctctcttggctttccttctgcctcactggctgcttctttccagtctcctttgctggtttcccctcatctcaagctggtattcttaggctcaatctttggcctgtgtctcctttttatcaacaagcatgctctacatgatatcatttgatcccataatttgaaatagtatccctaggttgatagatcttaaatttacatcttcaatcccaatttctcccctgaagttgagactcataattattacttatataccatctgtggttggctggtttttagacagctcagtttttacatggctgaaaccaggcaaaaccactgttcctgcaatcttcaactcagtaaatggcaactcctttataatggttgcccgggccaaaagcatacgaaactagccacaattcctcatttcgctttcaacactccacaccagtagccaaccctatcaactccacctttaaatgcttccagaatctgaccccttttcaccatacctccactaaaatggtaatataaactaccacaatttcttgcttgaactctttcaattgcttcctattttagttctctgagtctactcttgccccacgcacacccaattctctaagcagtaatcagtgtgatcttgattcaaatataaatggaattacatcaataccctgtccaaattttccagtgtatatccatctaactctaagtcttcacctacagaacccagtgtagctcactcccagacacttttttacttcatcattcaccactcactctgtcattcacttggcttcagccagactcacctccatgttgatccttggacacataccatgaatccaactcctcaggcgtctgacttatcataccctctatctagaagatcttctaatcagctacccttgtgcctctctccctcacttcctggaagtctccattcaaatattacctcaacagaggccatgactaaccaacttttctaccatagcacggcccaccacactctcccttccatgctctatctttttactctgtttttcttcagaatatttattgccacctgacatgttatatatttatgtgtcatctgtctccattaggatgaaaatgttagaagagaaaggactttgtctattttattccctgaatatttctagtacctagataattgcctagaacatagcaggcacactataaatgttttaatgaaagaataaatgcattataatcatacttttatcaaaaaattatttttgaccacttagtcaaatacctgattgagtgtggtatgtctgaatatttcaagaaaaaataatgaaattttcaaaatttctggcagcagttttttttttacattgatcaaggagctgccctctctcgtaaaaaggcacagcaggagttgaactgtggctgagatacccatggcttacccagtaattgagaaagactaaacaagagagtccactctttgctataactgctttttccattttattcaaggtgttaactaaaatacagagagctttcaacctactttttcagtcattaaactaaaatgccaaccaagtccagttcacttctaaaatgtattggtacaatccagtaaagaggagatgacaggaaaagaaaagtcaacaacactaagtatagtaatgttcctttttgtttcatgaaacccaaattgttacaaacatcaattttagaaatattttatgtagacattaaaacaaaaaggcaacaagaaatgcaaaataaacacacacacacacacacacacaccaataggtttcacctgagaatttgaagtaattcagagacagatttaatattctttgaccaatagagataccgagaaactgtgcacactaaaatgaaaataagcaataaaagcaaatagtactcaaaatttaaatgacattggttaacaatggagtacgaaaaggttattgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgtttttaacaagtattttaccagttctttacaatttgcaatgtcctctcacttgtctgattcccataaattcaaattaaagcttatttgaaaggaattcatgttttggcaatttagggaccaagcacgttctcactaacagtcagcttatcacctttgcacttaaaatcaaccattttttatttatgaagctccaggcataatccaatgctaggtaatttggatattcctttttgctgatcacagcagagacagtcctaatctgacaggatggcatggtcacaggggaaggaaaatatgcatgaactaaatgtaggtatccagataccacccctaaatggggcgcgcatagaggaaagcaatttggcaggagtgagattgctttccagctctcaattatttttctgctgttttttcttcaaattgtaaatcaaattcttttcttgtgcctcagtgcactggtccctgcatcttaagtggaggaagattctgacatttctatttggatacacggtgacttaatgtacacatttctgtggaatttgtctctccctacccctgagttatgttccatcagtgatttagtcatttaaatagagtctcgttgcacatcgctgtagcaccaaataggatttgatatttaaaagttgcttaaacccaaggaaaaataaaataaaatgactttctttctgaccaagcagggcaattcgataaaaagcttctgaccaggcatcattattgcctttgattaaaataaaatgataatttccataaaatgacatttctttttaagaatttgttatatactcagtgttaacaagaacagtttttcaaaatacaaagtgtttttcagggtcgggcatggttgctcacgcctgtaatctcagtactttgggacgccaaggcgggcagatcacttgaggccaggagtttgagaccagcctgagcaaaatggtgaaatctgtctctactaaaaatacaaaaattagctgggtgaggtgctgcttctttgtaatcccaactactagggaggctgcggcacgggacgcaggggttgtggtgagccaagatcactccactgcattccaacccgggtgatggagtgagactctgtcttaaaaaaaagtaataaaatacaaagtgtttttcaaactatctgtggggaaggatcagttttatttttttcaatgcattataaactaatactttagtaaaatacaataaaaatcaattactagcaaaatgaaataaaaatacaagcccaattttgtttatttttaagttcaatagtaaagctaatctgttaaggttgctataaaagtttctaaatggaaactgtggatttccataaatttcttattgcagactggtgacacagatgggttgggattgctgctgtggctttcttccagtatagtttttctggaacaatcacaaaaactaatttgctttatactttcctcccacgtaatctgggttcccaatgtgtcccactttctatgtcaacttgaggagagttctgctgagtgggatattgaaatctagttcatggaaaaaattggcatgaaatgttcatactttgtatctggcacccaaaactatcactgagacttacatacctccctcccctgtaaagtcatctcttttcttttcttttccttttctccttccttccttccttccttccttccttccttccttccttccttccttcctccttccctccctccctccttccctctctccctctcttgattgcttgcttgctttctcttctttctttctttttttgtagtttggggtcatcttagattttctgaagccaggtggagatacaccacggatcaaggcaggggccagaattcagggcatgaacagcatcaaggggagagcttaagtggaaggatttcagtccaagagaagtattaacatgtcaagacaattcagactttgatgggctttccccgtgcctcccccttctgagggggtgctccaatgcagtggctatctagaaggcagagtttttcctgtctcactgtactcaggagaaattagccacagtcctcaaaagctgaaggctgattaaccatctgagaaaagccaacctagagagtcttgaatgccagcttctgcagatgtgaaaagttagacatgtgagaaagcatgaaattcttttatttgctttattaatttttctggtatttatctccataactaaagcattatggttgccagtgaatttaaggtcttcagaaccatgttagatcacaaagtctcacatcgatttacatctctgtttgccttttagtttcaatttttgtttaagtatattcttcagtggaaagtggatttcatctgtttctggtgatgaaagagctcaacaatatgtctcatacaaatacttcttaaaacctaatgaatattcttatctctgaactacatatctgaccataaatatgaactgaattattctgcctgtaaatatgaactggattttcctttacacgtgcagctcacaacatgtagagctgaaatgggctttggattcagctaaatatatatcctctagtgtgtaacctccatgttagccaggcaggttgttactaaatgaacagctgtt

SEQ ID NO: 1653 - DNA, 8658 bp, Homo sapiens
gctctaattgagtcaaggggattaagacatttcaagttgtatcaatccatttctagttggattagataagcatgaaccaggcaagctggctctgatcagctagaatgagacaaattgaattctaaacagtttaattggaatcaagctttatcaatctaagttaatttctgtgctgcctgggaaacaaaacattgctttaagaactggtgtcactccatgcttgtgtcatggtggcaaaaacgatgagttgcttgccagtgtccattctcatagttttcttcactactagtggaactacttatgtggttgtggtcatcaatgtgtctagctaaaacaaagcaaaaaacaaacaaaaacctacattttctcatctctcctgaagagaaatatggcaaatggagtgggcattgaaaaataagttcttttctatttcttgtgcctgaattgtggaaaaaaatggctggaactacagagttgcaaccatgggtaaaacatggtgacttaattcatctctaaggatggcacaataaaaatatataaggatcctgggtaacatggtaaaggtaccatctcctgtttccaaagtggtcagtgctccttccaaatctcctaggcactcaccagtcctgctgaagactttaccttcaagcatctgtactctctgtccaaaggattactagggccatagggggagcatggtgggggactgtcagggagctaatgcccctgggatcagtttcaaccaatttatcaaccaatggattaacacctgttcttccccagccctcagatgggacatctccaaggtatattttataccctttcgccgatgtcatgggtaggatcaagcctcagttgctcagagcattaatttgctcactaataatcactactgattctcttccctttcctgtctcactgtaccactcccaaaacagtgtttcctggcatcaccaaatgaataggatacttgctctcaaatccttgtctcatgcctgcctatgaggtaaccaaatataagaccatctctggattgtctatcttggaacttcttttgaataaagaaacataagcctctttaatcaaatcacaattatttgagtattctgtaatatgctgctaaaccctttcttatctgatctgattagcaatgtaataatttcttaagcttaaatctctttattattagtagtcctttttccaatgaagaaaaactattaaaaaccaaaagccagaagaagaatttaaaagccttttgatttaataaaatctgatgcctactaaaataaatattgaaaattatattctaaatgtttacttttagcaaatacaatttcaacaagtaaatggctttacattgccaactagtaaatttcagttcttacttgactcatccatagcttttgatagagttggtcctttcctcctttctgaaaaatgtttctctaattggtctgtaggcaaccaccctctcttggctttccttctgcctcactggctgcttctttccagtctcctttgctggtttcccctcatctcaagctggtattcttaggctcaatctttggcctgtgtctcctttttatcaacaagcatgctctacatgatatcatttgatcccataatttgaaatagtatccctaggttgatagatcttaaatttacatcttcaatcccaatttctcccctgaagttgagactcataattattacttatataccatctgtggttggctggtttttagacagctcagtttttacatggctgaaaccaggcaaaaccactgttcctgcaatcttcaactcagtaaatggcaactcctttataatggttgcccgggccaaaagcatacgaaactagccacaattcctcatttcgctttcaacactccacaccagtagccaaccctatcaactccacctttaaatgcttccagaatctgaccccttttcaccatacctccactaaaatggtaatataaactaccacaatttcttgcttgaactctttcaattgcttcctattttagttctctgagtctactcttgccccacgcacacccaattctctaagcagtaatcagtgtgatcttgattcaaatataaatggaattacatcaataccctgtccaaattttccagtgtatatccatctaactctaagtcttcacctacagaacccagtgtagctcactcccagacacttttttacttcatcattcaccactcactctgtcattcacttggcttcagccagactcacctccatgttgatccttggacacataccatgaatccaactcctcaggcgtctgacttatcataccctctatctagaagatcttctaatcagctacccttgtgcctctctccctcacttcctggaagtctccattcaaatattacctcaacagaggccatgactaaccaacttttctaccatagcacggcccaccacactctcccttccatgctctatctttttactctgtttttcttcagaatatttattgccacctgacatgttatatatttatgtgtcatctgtctccattaggatgaaaatgttagaagagaaaggactttgtctattttattccctgaatatttctagtacctagataattgcctagaacatagcaggcacactataaatgttttaatgaaagaataaatgcattataatcatacttttatcaaaaaattatttttgaccacttagtcaaatacctgattgagtgtggtatgtctgaatatttcaagaaaaaataatgaaattttcaaaatttctggcagcagttttttttttacattgatcaaggagctgccctctctcgtaaaaaggcacagcaggagttgaactgtggctgagatacccatggcttacccagtaattgagaaagactaaacaagagagtccactctttgctataactgctttttccattttattcaaggtgttaactaaaatacagagagctttcaacctactttttcagtcattaaactaaaatgccaaccaagtccagttcacttctaaaatgtattggtacaatccagtaaagaggagatgacaggaaaagaaaagtcaacaacactaagtatagtaatgttcctttttgtttcatgaaacccaaattgttacaaacatcaattttagaaatattttatgtagacattaaaacaaaaaggcaacaagaaatgcaaaataaacacacacacacacacacacacaccaataggtttcacctgagaatttgaagtaattcagagacagatttaatattctttgaccaatagagataccgagaaactgtgcacactaaaatgaaaataagcaataaaagcaaatagtactcaaaatttaaatgacattggttaacaatggagtacgaaaaggttattgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgttttta

SEQ ID NO: 1654 - DNA, 5254 bp, Homo sapiens
tgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgttttta

SEQ ID NO: 1655 - DNA, 2140 bp, Homo sapiens
aagacttactgatggctgtctaaataagataggacgattctgaaattaaacccagtaggcagaatgcttctaaaggctacccaggcccatgtgctgaaacctatttcgttaaagtactgctgtggtttctcattccacacacacagtggtacctgactgagtacttcactgagaagcttgagcagaagatgcggctctgatgtagtgctgttaagttctctcaggtaactttagggttttcgacagcttttccttttaaacttaagggaggctagatccacaaaccgagcactagcacaggctggcacgaaacacagcttaactttcatttcaggcgttgtaggggcctatctctcttgctgacagttacgggtgcagtttaagcacaatctatttaagtggtgcaccttgcatggagatagacatgtatggtgaaagaggatgggagtaacaatggagtctgtgccgcagccagtctctgcttttagataatgctctgtatctagttactataaatttgggatagccctggcgatgaggatgctgtgggacactgtttgcttctttaaatcaccataaccactcataaacccagtctcgaggagttatgcgagtgtttttctctgtcctttctcttaacctgttccccttaaatatcgttacaagaaaacgtccactggagcatacttcatagcactgtgacagtagcagaagggagaaagtgactgttctagaggaacttcccccagctcttagttcctttgagtatttagaaagtggagtccaaagatttgttagcatttgagatgttaatggcaggttaaaacaatctaggctgctggaagacaagagttttctatttaagttaacaagataattaagttctcaaataactaaaagtggctagaagtcaaatcagtataagatgatggcaagctggtagggcttctgaattcagttgagaacacaatcctcgttttttaacttggttttgaacacttcattgtcagcagtatttaaatattaaattttaaaaatagattcctaaaggagagtcataacgggcatcttcttaaaccagctactctttaaaatcaaaatgctgtcactgccaataaataagtgcagtgtctttttcttatgggtgagtcagttatttagtctgatttcaatcttctaagtaaccttgcgaaatattaaccacgctacacaggccccacccctgactgcaggcaagcagaaattcccttcagattgtgtgaatggagatagttccaatctacgttacatgatctatacacaatagtatgttttctgacatttattcctttgattcagaaattcttcctcaaaaccatgtattttgaattctagtttcaaatatgtctttgaaaatatccatggcaggtttgtgcataatttgcattttgcttatttaccttggttgaggtttttccttagtttattttttaatttttaggaaaaaattctcaggttttttcaatcctaaaaaaccaaatttaaggaaggatagtttctttgtagaaaggtgattaatgaaaaatccctgttcttgctattctgtcattgagctctttcaaacaagcgtcggaagaccaacagacttaaagataacttgttttcttacagtacttaagatcactcttgtttacttgcgggatgtggcttagagaatcccagttcatatttagataatatgaggaaaccaacgtgaatccagtgggcacaagtacaataaatgaaaacttaatttgctttttaactaaacttacaaatacatgtgttcctatgcaagatttatctaattcataaattgcaagaaaacaggctagcttccttgtacacttaaatctctgaggctcctcactcaacttttgttttagtggaccctgcaaatgaggtaactagaccattgatgaatccagaagagggaagcaattgcctaaaatgacatcactactgttagcacgctaaaagccatggccacctacggattttcccaaggaggactgaggtggtgagggctacttgcattaccaattgtattctatattttccaccttcaaatagtaaactaaattagtcacacaggctttcctgaaaaagcgtctgattgcta

SEQ ID NO: 1656 - DNA, 50632 bp, Homo sapiens
aacacaggaaattaaaaatgcaaaaactaccagtcaatcaggaaatcagcattgtggatgtcagggctttgtaggtacaaattggggaattagttttttccatgaacagcagtatatttactaagtaatttcttttaaactagagttatccttttacatcaacagaagaaccaattagaatcactattcatcaattattgtcctaacacaagccttgtgttaggacctaggcaatagagcttatcaactaatcaactataattttaatcattgtatcttggagttttcaaaaggaataatttggggtaagggaaaaattcaaattcttagttactgctgacatgaaggcagatacttctgaggatgattaatgtatttaatcaaccattcagtttttaaatagatattagtgggttttttttcccctttttagtgaatacttgctaggcactgacaacacagtggtgaatataatgacattctttctcctcatgtagcttccattctagtgggagagaatattacatgaaaaatcataattacaaatagtaattatacacactattatgcaaatagtaactatataagcactttaaaggagaggaacagagtctgagaaacaacactggggaggtgccagtttatcttggtaagtctggggactcttcaaagaagagggtgacaataagctgtggcatgaaggatgaaaatcattcacatgcctcacattttgtatggctcagaacacagttatccaaaatatggcaccttggaggtcactctctgatctcctctcacctttcttccctgaaacatggtcataaataattatttgacctacctcccctaaaaggaggctgttaagaacctcattctggaggggtcctaccctatgcctggaagtcgagaagactggacaaacaggccctgcaaagtccccccctgccagcttatgaccatacttctgcatgattgtccagaaaaatatagttttccctgggcctttggatcttcatctctgaaggttcttgtttcacaaaaaattttggttaaataagtttgttatgcttttcttttgtcaatgtctttcgttatggggaagtcagccatgaaccttgcaaattggggtaaggaaaagagatgactttttctttcttacatgttcttccctgtctggttagcatcactctttctggtcttcccaccatctccctggccattctgactcagccttcatggggaatccttcctcctctatctaatctctcaatgctaaagtttttcagggctaagttctaggccttattttcttctaattccaaagatcctcccaaggcatctataacccattcctatgacctcagatatcatctatgtgttaacaattctgtaatagactttaccagtccagacttcttttcttagatttgggtccatatgccaacttcctatgtgacttcctcacttgaatatacctcttaagaacctcaaatttactatgagcagcactaaaaggtgtttcactctcaactctttcctccagtgatcttcatcttcctaaatggaatcattcgttcagttgctgtatcagtaatcaggatgattacatgacacctgcttctctctcatctcccataattgataattgataataattgataattgagccctgtctaattgatagctaaaatgtatagtgaatttcacattttcccatctctcttgccatcaactctggcatagatactgcaagcctttttcttagtcttccatctattcttgttcccctccaattcattgtcctaaatgaaaattttttccaataactcttttagttcttctgttgttctaaagatcaagtctaaaatcatcacaatggtctctaagacccttcatgatctacccactgcttaatcctttagtctcatattatgtcaatcttcacattattctctatgcctcagccaaaatacgcttttttcagtttctaaaataattttttttaaaaagggcgttcctttcttaaagaattttcacatgatgttccttccacctgagacatcacctgctgtgtattactgaagtactatactcttctctgtattagacaagggtgcatttggctgcaactaacagattacccaatggagatggtttcagtagtaagaacatttaattttaaccacttgatatcgcaaagtctgaaaggagtcacgttttgggggtgcaacatttcaaaattaccccaaaccaagactttccctttgtttctgtcattctgtgcatattaattttttaaatttagggtaattgccttatggtaacaacccgtatatcatgtctgatgcaactgcattcaaggtagaaaaatgcgagaagaatgctctcgtataaaattattctcaaggtcctcaccacatttccctacatcacattagacataactatgtcatagaaactgcaggggaggctagttaggtgaatattgggagataggcaagaagagaaggaggctggaatgcctgttgatttttacaatcaacagagtctgacatttgttagtgcacttatcaaaacagcagttaaaaaattaaatatctgcattttgttcattgtcttccctgtgagattataaactctttgactctggggaatatgtctgtctgattcaatgctataagagcctagactcgcacagtgtcaagcctacacagatcatttatgctgattgatggaatgaattaatgatatggaagagagtaacagaggcagaaaccaggtacaaaagagatagaaaactgccaacacaaaacttaaactgattgccacatctcatatctcatggtttagctttcctattccatttaaattgaaaacggtcttttcattaaaaaaaaaattggcaactttttgaaagtgctcagttctttgcacagtgaatagaattcccctaacctcttaattcatgccatgaaaatagacatgggttttattgtcactaagattcaggaatgaattctttaaaaaaaaaaaaaaccctgttaaggagttatatgatccagaaaaatttaaattgcctcaagtacagaaatgtaattcagttgttgtctaaattactcaaatatcagttaataagaaaagtatatgaaagctagaaagttacttaagagtagtcataaaatttttagtctaagttctccactccttagcatatcacaccaacagataagtttgtcagattggccgatttaggtagaaagcaaatgtaaaatacctcactcataaaggatgcttgatacatttttgttcttatacctagaccaaaagaaaacttgggtttattcctatctctgtcccatcctaaatgtgtacctatgggcaagttgattacgttctttggttcacaatcaatatggtaatcttaaactaccttttagttacaaatagtcataccacaattttgaaacttaaatttaaaaattaaatggtattgaatacattcaactctatccaacctaataaaacattaaggaactgattcatatttctggtagtgtctatttctatagaagcaaaacctgttcctagtttctgatggacagtctgatcatgtcaaaacgcacagggcactaacataaatatcacaatttctttaaaaagttgtaaatagctacacatgcaagactaggtttcaagttttaaaaatagttttcatttcaaataaaattccttaaaaacagaaaatgactttaacattggcaaagggagtcccctaagaaaaaaatgtaaacagatggctgagaaagatcacccacatgctgaacacagatcttgaggaggcatttctaagaatgaagtagcacttcccagcctgggccacttcccacaaggatccttatttaacccatggaaaacacagagtttatacctccggccaagaggagcctcaactttttttccacttgcctcacagtgatccagacagtttccaactctccctagcattccaaaagaagctaagtaccaaccacttgggatgagcaatcccctaataaattagtgttcgaagatcagccctgaacaaatgtcttcccatataaacgggctgttaagccctagctaagcgtattaagtattcaatttaatgtatgacacacatctgttccactttctcagtgagcagaagtttcaagataacttaaatcccagacttaatcaaggagaaaaaaatcttggcaatgtttaaaactgagttttaaaatataatccaaatgatggtgagagagagaccattttgctgtaactaatgagattatataatacctaaatcaaatccacaaaattacctgagcagaatcactaaatattttatctaggcttatttgtctttcatgtagagaccatcaacacatttcccaaacaccttcaatttacgcctcgcccaagtcaccaagagatgagcaaaaatgaagcccttggcaagcacagtggcttaacccccttgaagcccaaaggaccacaagaggaaaacttacagatttgtctttcacaaggagagcacagcactggatcccagccatcagcatcttgtgtgggttccaggccacagagtcagccctattgtttaaacaaagggacagagtagggagaggactcaattagtttctacaggcaatggaatactatcattatcaatatctgcattcagtactcatacatagtttactgttctatagaactccttatctgagtggtttaaggaatttggagggattttttgttgttgtttatttaaggaaaacaattactttgttttttcctattttcaaaatatcacttagtccaaagagatccctttgcctgacaaaagttggctgtacaccaggaaactacatttacctgtggatgccatgcagaagcttgcggtgcttcctcgacatcaaagctgagccaccccaagaagcctgttgagatatttacagtaccagaacaatgttatttcaatgttatttgtttaccagtgggttgtcatagaaaaccctcagtgaggacctcaatctgcattatttgatattttatgtcatgttaactaatttgtaccccaggaaattctgatcactggctctactcaggcaaccagaacctcatcacaatagatgggccctcactgacccttagaattataaattcatgcatcataaattggtatattaaccaactgagctatgtgtggatggaagaggttcaaagtccatgccctcttgaagcttagactctaacatagacaacatcttcacaatgctaacattttgctattcagtgtatgatgagacatgggctaaggactagtattttatataatgaatgaggcatattattgacaaggtagatagaaggccaactaggatgagctaggcggaaatatctgttaatgaaaaattagatcattttagctaaatggctttcagaaatatctacaaatgagagagagggcaagcttgggacaaaaggaagttatccactggagaagtaaattttgtgagcaaaggagaggggagctcagataaaatcccatagtcaacaggtctggagcaaagggagaaaaattgatgtaagaaatacaaaagtcagtatgcttcttgaaaatggtgcagacataaattttaatttgtaggacattaaaggataactgtattgagagaatttgaagggactagcttgggctgtattgaatgctttccaagttgatttaaaccttacagcattccattaggaatggagttatgatcacttccactttttataaagttcagaggtgttcaggtaaattgtccaaggtctcgccaatgacaaaaatcagatctgagattcaaagcccattctcctgtcatgttaacatcattacttaaggaaggtgacaatttggccaaactggggagtatagcatgtagaatgagggtgacagagatgctttaggcaataggtaagttcaggggttgcttaggatgtagcaacttctatttttggctatggaatttaaaggcataggtagaccttaatatcatgtaaaaagaagtggcatggttggctgcaccacagatatggaagataaagaaaatgaagtatctccacgatcctcagagtattacaaaatttgggcccattggtagccaataacaagaaagtacagcacaagcaactttgtggccttaaatcccacttaaaaacaactttcattgacagctgagactagggtgaagtgaatgagtcagggtgcataattcaaggaagaactcatctcagagctggactcttgcaaggccctaagagtgaatgcttcttaaaatttgagccctgccaaccccactggcctcatattagcaccagccttgtcccatggactaaaggctccatcaactccatggggtccccagaggcctgcgagctctgatgtgtttcaagggtgttgggtgttcaaatcccaaggattcccaggtaaagagttagtaacttggcattatcagtcaaattcccttcctgctgcatttcctcccttacttggattcacaatggaccacgtgtgactcaggctgagccacaaaggcaaatgccctcagcatctaggaaaattttatccccagcctacaactgaggatctccagatctggattttgagaacttggtccttgcaaatattaagatgtgttacatatcacatttttcttgactttcattacatattctaaatcctaaattacctacttttctcacttctcttatcccccaacctctctgagaacctatcagtgacaactacaggaaggattaattagtccagtcagccacacctgtttgctcgctcacactttccacctgcctcataccctacacttctactccttcatgctccctgagctagcctctgcctccactgcttctccaaaaaggtaaataatctcccaattctagtgaactggatttaagttttgaaatcacaggaacccttccaaggcattagttcaccacttcacaaagtactttggcagggttaggaacagctcatccataaatttattccttaaaaaaaaaaaaacacccctgatgtaaatgccctactttaatttgctgcactctaattcctaactccagaaactgtgaaattatcaaacctatcacctaaatgatggagtttggctttccatctcaataaagactgtcatttattaagctattactatatgtgaggcaccacagtatatcattttatatatatttgtctttaattagttaataaattaatagtagaaccaatcttgaaagggaagtgaaggtaagaatggaattgagatttggcagcctctaaaggccatgattttaaatacgtttgtgccttctatggcacttggaatgaggaatgggtgagagaataggaagctttgttgggaatgagaggctttccagcagctacaacctctgattttgaagaagagctagaccagcccgacgttttgttctcagacagaaactagcataacaattgccctcatgaaggaagagaacagtactggagtgaaagagtctaataaaactagtttttcttattcggttgtttaaaaaacgcattatattaccaaattgaagacagtatcaaatgtaagcacccccattttttgtgtactactaataaaaattgacatcaaaatatcaatttcagagttaaaatttttttaagtaagtgcatcttagaattaataaaacatggtatgtatgcagagcagcatggttttactgaaaacccagaagaacaagtaaatgtctttttatttttaaaaagagataaacatcagtttaatatttgaaagaagctttaaaatactctagaagatttcaaacaggtcaaagcaattattgcaatttgttaatattttctttaataaagtacctatggcatatgaagtttcttcaagataagctacatgttcctgtagtaatattttattgatttgacacccacaatactaaaggatgggtaaacatgtctttaataagccagataggcttgtgtcaaatttaatctaatactataggcatttgccagatgtatactatgcacaaataggataatttggtgtggtttacattcccttataaagatgttttcttcaaagactcaacctttaatttttagaaaacctgaagagcttttcattcataaatcacaattttctctaagccccataaatctcttaatgtcattcccaatttaaaagctgctgtggtgactgttttacataaactatttacttttctccattttatacaaactacataaactatataatccatatgtgatgtttcttttatgagagtacaatatttaggtagaactgctgatgtatttgattttcccccttatttccacagttacaaaaatgctcacttcatattatcttttaggatataatgtattgttatgcttctaagtctataaaaatcaataagatataagttgaaatatgaacagatacaaatgctaaaatcccgttaacgagtcacggataatctacctcaagtattgccattggcatactaatagaagcaataactctagtaaactttatactactgttgcttttacaaatgttagtattcagttaatgtaaactttgaatcatatcacagacactctactaggtgatatgatttgattgaaataaacactttgaaagcataaaatcatctaaactacaaaattatgtgggtatatccccccaaatgctgtttccttttgttcagcaagtcaaaaaatatttcttctgccaaggaggatctgaaactatcacttaccagaggaaagctcccaaaacaccatgtgcaattgtctctttggttagaatcaaactaattaactgctggtttcacacaaaaaaaattaattttaaaaaagaaaattaaaaagctccacaagtgttcatagttggctgaattcagcattctaacccgggataagtagaatttttaaagttaccttcgatttaaggaaatatgtattttgaataaccgcaggacttacaaaaattcttttaaaaagccaatcctttgctagaaaataatggagtatattatcccaacccccctcaaataactatctgatagatccagagaaaatttgctttagttatagcatgcaattatgcattgtagcttttttgcattttccagctgtttggaatcataattttagagctagaaagataccttacagcccacatctaccatcccccctctttacaaatgaagaaattgaaatccaaaaggctaagatcgcaatgaagaagaggcagatcagaatttcaaaccaaagtctctcggctccctaacctaaaatgggtgccttacaccaggctgcttcaatgacagtagatttgaggaccaaagatggctcatgggagtaaaagaagcaaaatggaatccagaaagctaaaacaaaatatacacaaagtcgtggaatcttctcatttatactttacaagaaagtggcatacttatttcccccaatttgagacacaaacaaaagcgttggggactccacatctagtttctgagaataagaaaaatttctaccaaggctacaaaaagaccaaaggttaaacaggtatgtacacataaatgaacttacatctacatgaagccagaggctgtgcctctcgcagatgtctgctatttcatccagagggtcaaaagctcccaacacagttgtaccagaagtggcacagacaagaaacggtgctgccccctgtaagaaggatccacacacacaaaattatcactgtcatcactaaatttgtcctgtaatagctggaaaatataaagggttatgcatccagagagttatttgggttttttggaggtagtcattaattcaatgggtgtttttaaattttgtgaatatgtggcctcttggcattataaacagattaaggaaacagaaaatgctatggcaatagcattttctgtcccaactcagtacatcttcagtattattctcatgttttttgtaatgttttgttctatcaattgtccagatagaaatttaataacttcagctgcaacagcaaactgacattttgtatgactcctaatttcttcctgaaaaaatacatttagcctccattgtgccatcattgtcatcttctcaaaaaaaaaaaaaggttggaagacagagctcccggagtaaaccatgcaggcctgtttgctcatctccttgtaaagtaagtgcagttataaaacaaagaatgtagaatattctcaggtacaaattcagcatcagaggagataaggcaacctcactgggatacattctccaaaataggtgctgcaacagagaaatccattggcatgtgctggaaaagaaaatctgtgtcacttctatcatggttattcctcctcatatagctgatgactgcatcttgtggcatgaacgggtactggtgggaaatagagaagaaaagggagaatgtgggtgcacacaaacagatgaatggttatctcggtcaagctagtcacatgctttgtccccattaaaggactctatgccaatcagatagatgaagagtacatgagattgtttccaaatggattgctccaggatggtggtagagatgtgttgctcgctgtgtaggtgaagtttgcagacaaatgtgggggtgaggggagcaagtagaatattaagattctagagcacctgagaaatagacaagaatatttactgcctctgaaagtttagtgcctctaaaagttatttttttctccatttagcatggagccattttttcccctcagttttataaagtgcatgctcattgcaatacatttttatgtcctttaatgccagggattattgtgtttgaaccaactctttccaatttaaccgacttttgacagaaagatgttatttctcaatggaaagtggggcagagcaagaatatgtggttcgcctctctaaactgagatgcatacggatcaaagtggtggtatataacaaatccatttgccatcttgggagacagctgtggcaaatagaatcaatcccatctacccaaaacttttagagccaagtcagtaggtgacagagccctggagaaaccagaggctttgaaacttcttccctgtattcaaactactgacaactatggctttatcataccagtgacctaaaggacataagaccagctttacaccaatcattaaaatcattaaaagcaatagaaaaataatttactaaaaccatttaagttgtctttaatggttgcgcttttcctcataaactatatgacatcctgacagtcatgagaaaatacatttgcaagctattatagcctattaatgagttttcctcacctttaaaaaaagatctcattaaaaatacaggaccagaaattaaacttttgcgatctggatttaacctagactttcttccccatatctcctgctgttaatgagaattcagtagaaacagtattgatggcatgctgccagtgagctgtattgtctaagaaaatttgtcatttctaacacaactctaacaaaatgtctctaaatattcaatgttcatcctagtttgagcttgtcagtaagccctttaggacctctgatgctttgtgtttttcaccatctatgtaatgacatcaagacaaggtcactgcaacagtttttcaatggattgtcataggccagggagttgaatcccagcagaaaaaatagttgatggtactattcctcatatctgaaacaacataagttaaaagcttgaaacaaaacaactaggcctgaagctactgagaaaaaatgaaccagtcatcatgtattattatctcagaatggatgcaaggtttgtccttggtgaatccaggctcaagtattagctgacttgaaagaaaactgaggagacgtactaactctaaccccattgccctacttttaaatgtgcctaaagcaatttttacttttcaaaaacttacttttttgagttctcaactttagtattatgtccgtttcatgtactttcactgtcaaaacaaaaatttgagcgacaaaaatgataatgactgtggtggaataaaaccctctatgctagaaacatgaattcctaatgacactaaaaaaaaatggggattatctttaggggatgctaggcaacaaactcactattttaaaaattgataaataaggggaaagaataagacgtttatcctgtcttgcctgtgcagtgtttccttagggaaacaaaatgaggaggaatatttttctttatagtagaatgcctgacaataaagaaggaaggagagaaggaattaggacatcacttaatgaaataatgggtctagacaatgatcatcaatggcagcaaaaaccactaagtgagaagctgatggagtggagggtattgtgatggatggactgacgataccagaccccaccaatcaatgttattacaaaagagacacaggatgtctcctgatggcaggagccaatgaagcctccctggttttaaaaaaagaaaaatacaacttaaatctcattgagtctcaagatctaactgccaaattacagaaaatataaagaacaaaccggatggtgcagaggaggtgagcacttagggtctcaaattcttgatgtaatccacaaaaatctataatgtggaaagctatatgggacaaaagacctgatcttttcaacaaatcaatggtagtggggggaaagaggaggaggaggaagctatagatcagaaaacatttacatttgacgtatcaaccaaatgcaatttgtgaactttatttgaatccttgattcagacaagtcaactattttttttaaaagggcaatggggaaattttaatatacactgaagatttgatattaaaaattatattttaaacaaaactatggtatgttgtttaagcaagtacgtatccttcataaatatactcaactatttatagatcaaatggtattatgtctggggtttgcttcaaacctatctagtggtggtatgagggtatgtggtacagatgaaataggagcatgagcctaatgactgctgattacagaatgggtatatgaagcctcatgatattagtctcttggtttttgtgtgttttggttttttaggaaacatttacaattttttgtaatgagaagtttaaaatttaagaagtggggaatagggaatggagaaagggaggaaggaaggagaaatgagggagggaagaaagacaatcatgacacaattaatattccccaccaacaagcattaacaacataatgcaaattatttttgataggaatttatgtaaaaagaaatgaaactaaaactagaaaacaatatctgtggttctcagcagaacgaacttacaagttgttactcagaattataccagagtcaaagaaatctgatcatgcaaaccaccagataacaataaagttcacttgtcattggaatgtttaaaaaaaaaaaaaaaaaaaaagtaggacacacacctgaagtcaatacatctgcaataatggcagaaattttaaatacagaagttcaagccaaatattgtgatctagcattctccaggactaggtagtttttatgaaaacttgaaaaaaaaaagtacaacaacagaactataatattcaaacttaaaaacattaaaaaacccatccttgttaaagtatgaactcctatgaggatagatacacttgtatcccagctcaggagccaggctttttatttttcagtagtcatgcctgcctttgttgctacctattggaaggttattggagaacggtctgaagctccatcagcaggcagcggtgggatgggagagaagcagcaaatctagcaggcttttggtccaaaaagcaaaatggctgagaccaaaataatgatacacctttttttttttttttgagatggagtcttactctgtctctcaggctggagtgcagtggtgcgatttcagctcactgcaacttctgcctcctggattcaagcgattctcctgcctcagtctcccgactagctgggattacaggcatgcaccaccacgcccggcgaatattttgatattgttggtagtgacggggtttcactgtattagccaggatgggctagatctcctgacctcataatctgcccgcctcagcctcccaaagtgctgggattacaggcgtgagccaccgcgcccggcctaatgacacccctttttaaaatgcaggtgttaaggccagccttggctggagcacagcaggtgcccagagccatgccttgccttctccaatatttcagttctaatatattctagcagctaaggaagaaaggatgttctgtcactgaactactagatacagacccaacaggggttgatagtaatagatgggtttgggattggaagcaacctgggagaataggttggtcaagaaatcaaaaatcaccctgaatacagcccagagaaaattggtttgtcctgcagatttctcagagggaggaattataaggagaggagaggctagggccctgctggagaggctggattgatccttagagctgcttctagccaagaatcctgaatacgggtgatttcagtgttttaatagtctccagccacctgggaacaagaatatccgggaaactccacagaacatggagagccaagcacttggaaatagaacatctgtaaatgagttttcctattttaattccaacattctctctcctctctcccacacatagaaatggttttggctgtttgcattctctccttgctattccctctctttcataagcgcgcgggcgtgcgcgcacacacacacgttctctctccctctcgctttctcccctctcacctcttttctggcttgccagacttgcttctccagttcctcaggtatcattttacctctaagggacaaagatttgagactttcagttatgtttagtaattaacagataatgatactgctttataaaccatataaacttttccctccacccaccaggcttccagatcctgttcccattaccttccatctgtttccacaaagcaaacattctcagtgccaatcccaagaaaagaggctgccttcttcatagagtaatgacactgaattcaaagggacagtggggaagggggagacatgaaaacatagcacaaaaaaagcattgcttattatcaaaggtagatgaaagtatggctgagcacaatctttgggacattattgcataaaaaagtaatttaattgagctccttagcatagtggttgagaacattcactttggggtcagagaaaccaggattgaacgtcaagtattccagttacagctatggaatcttgaacaaataatatacactctccaagcctcaatttcctactctttaaagggatcatgccaataatgcctactccatctgctcgtgctagacaaaaatgggttaataatatatgtagagggcttagcacagagcctggcacatggaacaaactaggacaccggaggctgttgttttccatcccattgagaaaagtaaagtttctcctgatgctcctcataagacttagtattaatggaaacttagaatctagtccactgctgacttgaaaccctctaaggagagggcaagactctatctcaaagattgcaatcacaggctagagaggaatctaattatttcctagagcaaacaatgagttataagtgctgatcagacacttgaccaatcttgtttaatactgaacacaagactgaaacacccaagaatgtggctaaaatcctaagaacaaaagtaataatagacaaactactttactcagctatggcatgagtgaggctaatagatgaatatggaattaagtctggtctatttcttattgataaatagtagtgtgtgctttacattattgggccttctctatactacatgaagcccataaaataattagcatgcaaacattggatatgtcgctcttcatacattagtgaggacaggtggtcaattaattctttttcttgccagaaaaatgaaggtgctaaaggacattattgtaccaaaaaaaaatcttagtaatttgtaggtatgaatacattaaaagagtagtcatgccttcacacttcacttgatatattccctcaaatgtggtaatttttttccttttgtcaggagagttttattgggagctctttttttaactctgtaaaaataaatgcagaagtaacatcaggaaaaatgaaaccgttctaaataattaatttccaaatatcaaataggacatgtccaaaatgcctgtaggatgcttttatttcaggttgttaaaagaccatatgcatattgaagagtaataatgtacaagaaagtgtaattaattctctacttgctccaccagcctatgctggctggcggtaacctgcctgccatagctaaggtgacatagctcgggtgaattatttctcaccagagagttgagctctggcaaccaaacagctattgatttcataatgataaatgctagcctaccccactgacatctaactataaggaaaagcacaatgctctccccctgagaaatagcaaaatatctccaaccaatgaatctgctgaataaaaatcttgtaatcagaattagaaaagtggagctatctttaagtacctgagggcaaaatacaacccaatgtcaatctgagatagatagatcaaaaaaaaaaaaaacaaaaaactgcaaaactgaagtttaaacatctgaaagcttcagagaaggaagagccctggaagggagaacaaaagaaggtgatgcttcagacatgctgagtagtttcaaggaaaggaaaaacctagaaggctggaattcagaagtaacaactgcatttagaaacaaacagtggcgtttctatcattggcaaaagataagtcagttgttctaagactcaacctccccacaggtttcataaatctacagaagacgaaaaaaactctcagcgggtgttcatttctataaagataaaatagcaagtgcctacatgaaagagagcattgagctggagttttactttctggctcccacaaggatttttttctatgaccttgagcttctcaatgaactgctgctttctcctcaatgtacactgtgccctggacacctggactccagtgctgactaatttgattctcaagttagctggtagagagaacggggtatataaatgtacactgtgccctggactccagtgctgactaatttgattctcaagttagctggtagaatggggtacataaatgttacattttagagaatgaacaaaaagagtgtccaagggatgtctctaacaacacacagctggtttaattccccaagaggccagaaccagaagccagatagactgaacccagcctcatgctctgcaggatgtcctacgaagcacctgcttgcccgtggagaagacctgcaatcacatcccatcgcaactcaacctcagccctcacccagcaatcaggaggaagagaaagaggcacctagagtgcaaaatttagaggcatgaccctgagacacaccctacataactcacttgcctctcctggcctaagccctgctagagaggagctagcccattgattactggcctgggaggtaagggtttctttttaccctactttttagtggcaaatcataattactgctttatgctaattccagaagtgatctgaaatatacaggaactttacaaacacgggatttctatacacccaagaaatttatatcaaagtgcaaaccaagacatagatttattacttttatttctccaaaagtccccttctcttagatgcctatttagcactagagaggcaaccttggatatattgacagtgcaaaggtctttgtcatgaccttgcaggtctttatcaatagtaaaattacaataaaagcctaacacatgcaaaaacaccttcagtggtgggtacgtatattctgcactggatggtgcaagatagaaatggagtaatttggggtagcacaaaaactggaaaagactacctaatataacagtactgggccatggaccaaacccttaaaagaaaataagggaggtatagcaaaaagactaacgcagagtttaagactgtttactaaacacaaccttctttaattctttaatgaaatagatggatttgttgtaataagtagtaaaggcagtcaataaaatatgaattaaaatagtgcaaatgctataacctgactctttgagtagggaaaggaatgagctgcaaagtagtgtcttgaccaatggagtcaaaatataaattcaaggctacagtgtgctcgaagtgatgtaatttttctgtggaattcacacctagttcttggtttttctggctccagcttctgctgacatgttagccaaggcatatattttgcctctctttggaaagtttttaaaaaccacttagttatggtttcacaactacataaggtttcaatttcttttcactcccaattcataagccccacctgttactgatctttcccaggcgtaatctctgttctaggcttccacgtaatatcttttccctttccatggtaattattccagaaaagaactccagcaagctttaaaccaaatgaagaatgaaaaaggcaaaagtaaaaaacctgagctgataacctgggcgctatttaatcagctttcccaagcttggaaatagcagtttgaatgcagaagagactctgcatttattatccactggggtccctcacattgaaacatccagggctgaagcatgaagaaggaaactctattcaataacaatcccaaataatcaagtactttttcccagctgtccacattaccaaacattcttctcttggtacagaaggaatgacttatgaacaagagcctcgaatggctgagttaagaatctcaggctagatgattcctcccagttgcctcctgtcactcaactcccactttgcacttagtgctgaaagatccagagcaaaggtcagagtgagaggaaaacatgagagtggtcatattttctcctactgaggagaaattagtgcacaatttgtccttttgcaataagaaactaacttttgtatttagaagaaaatgatagatacaggaaagcctagctggaaataacagactctcagttttttattttgtccacttcatgttagtggcaggatacctgatattatctcagaaggtaagaagctaaactcattctgccaagaacctgggtgatgaagcagtggtagaatagacggaggcatccactagaatcacacaagaataggaaagggaaaaaatctcttccaataaaggctgcacttaagccgtgccatctacttctgcccaccttgttgcagctggaacattctcctagtaacaattatagttaatattttaaaaaatctattatatcccagatgacactttacatgcaattactcatttaacatttgccaaaactcactaatcagcaactactgcgtggttgctggattgttctaatggttccagttgttctctgttccgtgtattcaaatcctttgcctggtgactttacagcaagtccccccatgaggttgtggggtctttcttcccacatcttgggtctgggctcacagatgggattttgccaagaaaatgaggcagaagtaacaatggccagttctgaggctaagactcaagaggcctgatgtgttgccatgcccttttatacctgcaccattgccatgaggacacacctagactgacctgatggagaatgagagacataaggagcagagaggcatcactggaatcatcccagctgagccactcgtagatgggccatcagccagccaacccctagacatggaagggggcccagccaagagcagcaaatctgcccagctatcttgagacttataagtgataatatacagttatagaatgataactctatatttggggtgatttgttggttataaaagctaagtgataaacttatttttacaaatttaggaaactgaggcacaaagaaattaactcactcaaggttactcagacagtaagtgacagaggcagggactgaatccaggcagcctaactcaaagcctatgcgcttatctactgtctgacccacctactttagtggagagtaaaataagagatggagaactgtggcaatatctgtgtgtgtgtgtgtgtgtgtgttttcattgttactgtatatctttcttttccctggaaaagtaagatacacatcccttatattagccaatcaaagcaatcattttaaaaggaaatgtgagtagaagacatagctgagatccacagtgttcatctaagtactaacaaataagacattcaaaaaaagagattcacagagatagcactttcaaattaaatattcttttcttaaaatgttgttacagactataaattttaaataaaggtaattatacaaaattggaccaggcgttacaacatcaaactcgttagaatttactttggaatgaaatactatgttatactgcagcatattagtcacatgggtataggacaaaatcacatcaggaatcttcaaacaaagccctcttaaatatgctttctcagaaaatctatattcaataccaaaaataatttttacctctgcagatgtgaaaaggattaatcttggcgaaccagacagccccttttccttaatatcaggacaatatttgtatctagctaaattcattgcatacatattggacactgagccacctgcaaaaacaaaattaaaatggcatatttatagcatgaagttatagctcgcaaaatgctgaatacagtggaaagcatgaatggccatgactgctctagtctaatgaaaaatcaccgtgaaaagcacatgaacaccgacctccctgctcccattattctgaatattttattacataccctaatctctaattctagaacttttattcttagaagataaattttggtttattcccatgacaggctttttttcaaaccaaaagtctcaatctgtgagctctggacttagggcctttacctaggtctccatagttaatattctttgtcacctaatcaataaaattgaaataatatttgttggtctctggctacaaaaaaggactacaggataaacaaatgtaattcagaaatcttctcaagtaaaatttgattttaaaatttagaggacttacagcccttccaaacttccagcatcaaatcgattcatttgtgttagatataaatcctaaactgtaggcacctcattcattaagtatgtatgtcatctatttagcattaatacaaaatattatcactctggagaaaggcataagctagattctcagcaagtagaattattaatatccaactttttgtcgtgtataaatctgcaaggagttgttcctcatggataaatttttacgtggttgtattggaaggttgatatcaataactaattgtactcacctgggttaaatattccatccccttctttccagccaataaattcaatcattttcttcagaaccgcttcttccactaacagaaacactggggacacctcatacgtataactagatagatataaaaaacacttcacttctatgactagagtcaaaacattcctttggtgtcccaagaaatgcacagagttctattaaaccaagtggctgctgaagtgtaggcagtctttggaaatttatccattgaaaatagagaattactccatcagtgacagcactagtcatggttagataaatgccaatagcttgtggcctcagggatctgcaagttgctgcagcagtctttcgagaaaaacctcaattccgtgaggagcaataaaggcaatgcatttgcgtgctatgtattagccatgagcagtggccatttcactctgtggatgcttggaacactgacttggatgctgttgatggtcaaagaaaatccattgtcatggtaaccaagttttatcagattactgccatgagtatgctaacagtcccctctagatattctaagtggagactactccacctgaaccagggcttcctctactacactctctgtgtctgtataaatgaggagtgttttgtgagacatctcttatgtgataattttactgcaaagcactacccaaatcccttgtcaatgaaggatgtgttgctccgggctggaacgctgttgtcagagcattgatgttttagcccctttagagattgccttggctgcagggagctacctcctccagggtcacacccattcttgtggtggtctacacctgataactgctggagatgtaaaggcctagccgtctgggcctaactccagacccctcttgaagggccactgtagttccagagatctccgagcgtcagccaagattgtcatggagcctgcgtggcaatttgactcctatacttgccctttcttgcatcctcctcctccttccccaggtcgtcactcatgttgatcccaagggtactccttaataaacgtcccactcactaaacaccatctagagcagcattcttgggaacccacattgtaacagtcaccatgccttgtttgatatttattttctctctccagacaacttgagggtgactacatatctatgatctccttttcaattgagggattacattaaattgtatctgaataaatgtgtactctaaatatgtaagttaagcagacacatttagatttatagtcacagaatttaatgcaattattttaacatctggaaaggaaaactttggattgaggcataaaagctggtcacctactatgtatcacctactatttatcacctacatatgtgtcaactctacagatgttatgccatcttaaaaataagatagattcagctgggtgcagtggctcatgcctgtaatctcagcactttgggagttcaaggcgggtggatcataggtcaggagttcaagaccagcctggccaagatggtgaaaccccatctctattaaaaatacaaaaattagccacgcatggtggtaggggcctgtaatcccagctactcaggagactgaggcagagaattacttgaacctgggaggcggaggttgcagtaagctgagatcatgccactgcactccagtctgggcaacagagcaagatttcatctccaaaacaaaatttaaaaagatagattctgtttcttaaccacgttatgaagccagtgtacatacacaaaaagtatgaaaaaagcatatatttatgtgaacctacaaatatatataaaatagttactttcataataaaaaaaaaaagtatttagcctgtctttgaaaactggctcaattataaacctaggaatcagcctggagggtggaggaaaagataagatagaacacactcatgggttggcatattttgagtggatggtttagcttagcagcaatttaacactcctttaatctgaaatatttagagatttttgaacttagatgaagagttagaaaacctgggatatacaagaaaagattgaaaaaggtgtgtaattttactgtctctcctgacttaccctcactgtaactgattgtaacctggtatctgctgtcatcactccatcaaaacctccctaaagttgccagtgacgtccatgtagctaatccagtggatgctgtttaggctcttagttgaatattcaacaacatgtgacactaggcatgctctcctcgtggctgccacagctagccttttgtttttttccttctattctcgccattgtaagctgaccctgttcctcctaaccattaaatgttagatgtcctcaaggcccagtattgagccgccttctctccccactctatactctgtcccctaggcagtggttctttatcttggcttcccattgaaatcacttgttgaactttctaaatatatcaatgcatggggcacagccacagaatttcagatttaattggcctgggttggcacccaggtatcaatacatttttataaaattctcaagtgattttcatgaatagtcagggtggtgaatcactgacataggaagtctcatccacgtccaccatttcaattaccataatttcactgataattcttaagtttatacctttcatatagacatcagaattccaagcccatatatttctcagcttagttcctatgcattcttggatattttaaagtcactgcaaactcaaatgcccacaactgaaaatgtaatgcttgctcttgcctccttcaccatatacttgaaaaccagttccctctcccagtgcttatttctatgaatgatatgaccatgaacctagctatgaaagccagaaacccaggcattgtcccaggagtcttctcccttttactgttattttcaagctgtgtatcccatcctttctgttttattttttgaactcattctttcccgctctattcctatctcttctctccaagtccgagctactttcctctctcacccgactaaagtaatgccctcctaacgggtcccctccaacctatttatatttttagagattttttcagtaagaaaatggcacctagtgacttagaaaccttcaatggctttttgttacatttagaaagactcataaacatggtcacctgggccctatatgtctggcttctatctctctctctctttctctagtcttattctccactacagtcctgtaactctctcagctgtacccacactggcctttcagttcatagagaatggcatgctgtgtcctgccacagggcctttatacatgtcattctgtctatttagaactcatccctcaccttatcacctaataacacttattcagtgtcaactgtcatctttgcagagcacactctcctgagcttccaactaggaaaaattgtcccattcatatgaatacttagaacactttgtacttttccttcagatgagagtttggattttacattaatttttgtggaccacttcgattagcatttttataccagatattatgctccatgagggcagagtcaaggtttatttgtgttcaatatgtctctccatcacttagcacagaaaatgacttttcatgcaagaacaaataaaaaattgcctaatcaattttctcatctgttaaatctcattaaatgagataataatgactgccttttccatctcacggtaccactatttaaatcaaatagctatttgaatactgataagtatcataaaactattccattatttgcgatggcactatgcaaaagaaaccattaaatagagatttttgaaataaaatttcatctacttaaagtctctaatccacgtttggtgtgaaatttctatagcatggcacttacacacttggattcaatgcttcggtcataaatcgggccaccaaggagtaataatcaagtccagcatacaattggttgaaaaatcttgggtggtctgtaaatttaaaatggagtattcatctatgcagcaataaaaaaaaaaactactgatacagcattaacataaatgaatctttcagaaaatgaaagcagacacacacagaagagttatatataacgtaattccatttatatgacattcaaaaccaacaaagctatctaaggagatggcggttagaattctaggtactttgtggaaagaattatggattgggaagggacttcagagagcctctggagtgctagaattggtctatatctagatccaggtgatggctccatatgcacagctacgtacaaattcatcatgccgagcaattaagatttgtgcactttactgaatataaattatacctcattctaaaaaaatccaaaacaggatcatgcgcaaggaaaaacatgttgaagacacatcgtagagccctttctactggtcagtgtttgtaagtaaaatctgagttgtcttttaagagctttgatttacttgctcctcttttttacaacccagacccaaaccagaacccttaaataattatttgaacactatttgtccaaggatcacagggtactgcctttttttctgaaaatatcaatattaacttctcacttcatatacatttcactcacagcagagttcaccccaggctatggcactgagcagccttttcatttttcagattggacccatgcgactggcagtatatagatggagtaagatgtgactcactatgcggcttacatacacttctgattcaatttgcttgaaatgcaatcgcctttaagagacaaacaatggcttgttccaattttaatttttttcccccctcctataaaaggtctcataaaggttcttggctttacaccatgtgaataatcacaccatacacccggctaactggcttggcattctcaatctcaggaagctcagcatgacagaacaaagaggcaggaggtctatttctacatttgagtatttgggaatcatttaatttggtgacctctcattacaacttacagcatctggttttagtttattttagttttttttttctctctttaggggttcaataaaaaaacaagtctcaaaagaaaatgtcttttcagcttaaacatggaaaacttcctctgatctggcaaaaaaaaaaaaaacggcattgctacaagtaattttaataagttttttttagttctgtgttaatttatgattgatttccatggtaacatggaaaatatccagtaaactgaaaaatctactgcattaaatgtcattctgcacttttgacatgcactggtaataataagatacatatctctgcttttgaaatgctaactgagtttttgatacatacaccagactttcccaaaggaatataatccaattatttttagccagaattttactatgttctttccactaaacttagtccagtgtcagaatttacaaagtaatgcctgtatgatcttaagcgctagatacctttacattacactgacaaatattttggaagattattctcccatttttgaaacttgttcgctggatgaacaggatattaacaggtaagctagaatggtgcctcagtgtaagattgacatcacattactgcacgtacaaagttcacagtagttatgacatcactgtgaaataatctcatcaaaaacttggaatgtattcatttgtcttatatccatctaagggcttttatttatttgtttttggtacagccagatttgatcaaatagtttggcaattaccaactgccaagagttaatcagtgtcttccaaataaatcatttctgtttatattaaagataccttttgaacactttttttgcatactctgggccatcaagatttaaaatcccttaacaaatttatataatcaaaatactatttgccagtttggtctaacacaagaaatgataagtagcagtgataatatatgatcttgattacaactagtatgtgggggttggcaaggagaagaggatatttacatacaaacactaacacctacagttttcctgtcaacttatctttggccttggcaatgaatctggattagggattaaagggaccattgcaaaaacatcagaactactaattttttgatccagatttctcgttccataagcattgctatactcagctttgagaggctttgcaaacataagaacttgtcagaggtacagatcaaggaagtaaattaaagttcttactagttttgacactgtagtgtatgacatcccgacagagttccaatagtttatggggtggctcgcctgagtctctcatctccaaatcaagaagctgtttcagttgttcaggaggcctccattcacacacctggagattcaaccacaacacaaattgagtatccaccatagccaggtattgagaggatgttacaaacgtggactctaccattacaaagcttctgggcagcgggtgatttaaacatgcaactatagttcagacgaaaagaactattacagtaatgtagatgttgatgggaccaatgaggggcgccatcttagatttgcaaggtaaagggagatttcctagtgatactgatatctaagttgttacatagaataagagtagagcgaatcaaagtttagggaggttctagatggaagtgacagaagtaacaaagatcaaaagtaaaattaaaaaagataaaaaattcggatcctatggcacatctgtaaaatcaagtacatttggtatggcttgaacatggatttttgagaaatggagaggaaataaacaggaatgctgaagcagtttttctctctgtgtgtacccggccctatgcagtctgctatcgacctagcagccagaatgatcctcctaaacttaagccatggccattcctctattcaaatacatctgatggctccctgtttctttcaaagtaaaacctgaggtccttacaaagatataaaatgatcctttacgatctgcttctcctggtttcatttttcctctagtctcatctgggactactttccttctggctaactctgctcttgacaccctagcctccttactgttcttaactacacgagggaggttcccatactggggtctctgcactgtgtgtgccctctgcctagaatgtttttcaaaatatcctcataactgaatccctcacttatttcaaatctttgctcagaagtcactttctcaacaacagcaatcctgactcccttacctaaaattaaaatctacccattacctctatcaatcccctttaacatttcctactattcctttttacaaagcacttatcaccctctaatatactgttacttattgtatcctacataatctccatacaagcagatctgtctttttgctcactgatcccaagtgactaccacagagtctgcacataatagtgctcaataaagatgtgttgaataactgaatggataaacagagataagcaaggctcagatcataatgggctttatgtgacatattatagagtttggacttggctctaaggaagccattaaaatgtttaggacaggggaatgaaaggatcatatttgtgtttggggcaatagctttagttgttatgtggaggttcccaataaaatttgaaataagaggttgctgtaataagccaggcaagagaaggtgatgatctggatgacagtcaatgctgtattaaatatgtagtttttagagatatttaaaatgcagaatcactagaacctggaaatcagttagattttgagggtgagatgaatgagccaaggatcatcccaaggtttccagcttggacacaagattggatggcagcaatggggatagcaggagaaggatctggttggggtggtgtggggatgatgaggtgaaagcaggtttaggacaaggcaccttcagaatatccaaaagctgtatagcagttgatctgaggctcttgcaaaagattgaggacagagttccagggagacactatgataatgtaacagtagttgatgtggctcagagagaacctacagcagggcagaaaggagcagaatctttctgggcatcaccaacacttatgaatgggcataggaagaggagcctgactgtcctgtggagggcacgccagagaggtagggagaatcctaagagtttagtgctaccataaccaagaagaaagaatgctttaggaaggagatgttcaccactgtcaaatactgctaagaagccgaattagatagacttgaagtgctcatggaatttatcaacaaggaggtgttcttggcaagagcagcttgacttagagaggtgggggcggaggccagattgctttgaagtgagaatgtaggaggtgaagaaacggagggagggaatatagataatctctaaaaattttggctgtggaggggaggagagagatagggaagtagccagggagtgaaaagactgggaggctggggggaagcaggaggaaataccaagttgtgcaagtagtatgaaattaaactatgatgctataaccatgacaggcagaggtaaattggaaatgcctgagacaatcaaaaggaatgactactggcgcattcaacaacatggatgaatctcaaatgcattttgttgagggtaaacagcaagactcaaagcctactaaaatactattccatcaacatgacattctagaaaaggcaagtatcatagggaaagaaaatcagtggtttcaggggctagaggaaaggggaggattgattagagaggggcacagaatagttatataactattctaatgaagatatagaacagttccatcatatcgtagtaatagttatgacttctgaaactcatagaaccacaccccaaaggggtaaattttactgaatataaattataattcagttttaaaaactggctgatgaagaattttctgctaatgaaactagcagtgatcactgcaccaagcttgggtatatatctgcaggctaccttttaatggtgctctgttggatctcaaacaaggtaggctaagttagtggtatcaaaacttcacctccttcccccaactctagcatagctttcaatccaacttcccgtgggtagcctgcacatctattacattgtaattgacttgtggttccttaattgacaacttaggatcttaagatcttccgtttctcatcttattagtcccctgtgtgagctctttttttctgggcaaaaaatggtccccttgctgtgttaagtacatcttgtccttttgcaatgctctttccattattgaccttcctgctttcttcctccagaaatgagtaccctaacgccaaactttctcttcccctgccactgccccccaaaattctcacttgccctttacttacattccacatctgagctcaaagtactcgctcctgagtgaaatcccaaaaatctgttccagtctcaaagcatttatcacatccttactgggaccccccgctgccttttctaatgaaaacatatccttccaattagattataaattctgttcagagctgggcctttatattgtttttctttatattctctagggctgaatataaagctttagtcatagctaatactcagttaatatttaatgactgaataaaggccaataaaaaaaactgccagaggagcagtgtactccaatgtaaagcagatccaaagtatttcacaagtacagagaagaacagaaattatataattataaatatgctatctgggcaaataccaaacaccatcaggattttgccttgaacataacttccaaattcatgcatcaatctattttcctactagttttccgaaaggcatgtgatcaaaaattcagaataaatatcacctcactttcaaaatcttttaaaaatgatacttatttctaactaatataactggaataaaaatctcttccttacatccatttgttgataatccacctccaacatgaaaaccaatgtgataaaggttgattcggtaattttaagaggcatatggaatagttaagagtgcagattgtgaagtgatactgcctggattttagtcccggctctgatacttgtgtataatcttgggcaacatatttgacctctttgtgcctgactttctttcccagctctaaaatgggggtaatagtatctgccttttagtgcttttgaaaggattaaatgcataaggagtagtccttagaacatagtaagtattcttaagagtagatgtcattagcggcggttctaatatcaatttgaattgaatttgagcctgaatttgaaatctacaaccaataattggtaccagaaaggagtcagacttaaccacctaagatttctaggctaaatttagacaagctcttcataaggaccttaagataaatttaaaatgtttttacatccttttccatcttttgcttgattttcatgaacaacatgaagagtgtgcactagaaaatggggagcaaagagcattagagagttgcgtaagtgagattagcaggttacttatctatgttattatctagggtgcaggaagtttcatccctgtgcttcatgtccttatgtgattaagctctagggtctcagccaatcttcccacgaatgatgactggcagagtaaggaggcaacccttcaaggacagcaggaattgcctgaaggacagcctacacttttatatctggacatccttttgagacaaaggcatagaagaaataaaaacttggccttcccatttgctttctattcagccatactgatttggggaacatctatctttcccatttctgcaatttcttacaggttttaatttttaccttctcattgacatctgtagctttcaaaaccacctcttccattattagcctacaggcctcttcaacaaatttttctccagcttttgcatctgttgtaggaccattcagcacaaccccatccacaagaacagcattcttcttacttggaatcatctcttgttgatcaatatctcctggaagcaagcaaacaaattgtgtttgagagataatctaattacaccacataacaaagcacgggacaaaatgcatcactatcccagcttcagatggcacatcttttaatacatgaaggcatcatttgaggtgttgagctgacaatttcttatgacacaccatggtatgatagttaaggaaaattttacaaagaaagctcacaatttatggattaagtaaatctaccttattatatatgtcactctgtactgggctgagttagtcatggagtatatgacctcctaattcagtgcaatttcaggtctgatggggaaaggtaccattcacatacaattcccatgctagatggtgtttgaagttgaaaaaaaatgttttccataattagaatgctgattcacaaagcaactgcccctaggagagagtaaatattcattggcatttctacacatgcacaaatgattaagtgatttccctaatcctttcctcagagacagccgtcactctaccacaggagagttcgagatggaggaacaggagttaggcatttggagaaaaggatgaggagaaagcccttcagattttatctagaattaacaccacctctatgctgtcagtatccccttaaaatataaataatacaatatcatacaatagtggttttaactttcagaatctggtgcattgagtagacaaatcctataattaaggtagcaagcttttagcttcatttccttgtacaaagtcctttagcatttctgagccctaggatgaagctttgggcagagataaagaaaatagcacctgtccttacacaatttattttcctcaaggaagagataatgcatttccagattgaaataacaaattgaattttatgaagatccatcttgtattggatgtatctgaattatcgaagtatctaagagggatcacctggtcaccttcaacaaagtgaatattgaaatcttcaaaggcaaagagctagctgcttccttcttgaactagcacacatgaatatgtttctccaaatgtatgtcccctcttcctttaggtgcgtgtagctgttggccaatttctctatgaactagattacaaagtttacacaaaagttgtatttttcattcttgcagcatcttgtttagcatcagggagtgtggaggagaccaagaaatgtaaatgtaacctattttactcattcttgcagtcacctttcaaacacatgtacaaagagatcttcgtaaacataagcccatgtctgtttcacacacacacacacacacacacacactctctctcacactcacacactcactctctctctctctcgtaatttgtcagggataccatattttcccttttaacaaatcattccttaaaaagcagcagcgatataaacttgtcactaatcttaattgtatgttttaattctatgtttaaatgttcctctatattacagatactgctttgtccctgagagcccctaatttttcagccattttctacatagagagtgatagaggaaagaaagcagcacaatgatttgttaagcctgtattaaatgcctttaaacttttcaaccttgcagcttaagcacaggcaaaaggatgagacggaacatgttcaagactgtacatgccgatcattgactaaatgttaaaagtcaacatgaaaatctatatctgagaagaaaggttactgcctacccaaaatagccctccacaaaaataattctggcaactcaatccagatattcaaccaatttccagcacaagctttgattcaatcacattctctttttctaatcagtatgtttctccaccttataatgtatatgttcatttaattgttgaaattgacagaaacaatttttaaagtacttttcagcactgtacctcacacagtatcttctattttaaatccatcttaaatattccaatggtctacaaaaaaaaacccttctaaatatatgtatttcaaacacttctactcttagtgagggctctaacaatattaacatttatcatttcttagactccaccttctcctcaaagttaaacgttctgataaaattctatggctccacaaacactttaattctgttattggcaaacacaaatggtgtctatgaaagcaccagataaaaatgttacaggaagatcccccagttggggaaagatggaatctgcagcaaaggatcaatcttttgtcctctcactgaaaaagaagccatttagagctccaatgaagaatgttagttccagccctcactttcacatgaaaggaaacatttaacatggtttagggccaaatattgaaaccctagaattgagcttttagatggaaatgctctgcacctgaaggtactttcctctcctcccaaattttttaggccctaaaaatagagtaagaaagagagcaattattccaggaactctggttatgtgagtaggcagtgctattattaagcacgcagaaaaagttaagattttttttttttaacctcattagtaggatttcaagcttttattacccagggaataacagcagctctatagcctgctcattatgtttctctttctctttctctcaccccgttccgtgtgtgtgtgtgtcacacacatacacacacacgataaaataaaaaatgtcaacacccactcgtaaccagaatagcagtgaaatttaaattatcactgtcttcacaccaatgaattaaaaaaaatccccataattcacacaattatctaggagaaaatactgtaaaaatctatacagaaatgggtctagatgatgtcttttctttgatagacacattttatttttatagccagatgtgataatgtgcctctttctcccccagcatttgtccaggtcagaaaaggccctctggagactctagaataggtcaagctgtggtctcctgaggaaggatattcagaattttcattctaactgctagagtttatagtggctcttaatgaagtctttcaatttgaggaatcttccatgaagactatacctaggatatgactgcttttcatcacccccacttttactaccttagttcaaaccaccttcaaatgctagggttactgcagtagcctcccaactaaccacctttcttcgccctttcccctcattttctgtggactattctcaacacagtacctcctacgttcccttgaaaagataaatctgatcacatgatgactcctgcttaaagcattcaatgactcctcatcaaactaaaagctaacatccttctaataacctcaaaggcccatttccctattatctcatggacctcaaacctcatcttgttactgtcctccaagctcacacagctctatcatctgtggtctttttcaccatgctgattctttccttaaacatcagtttctcagggaggccttccttgactacctcatatgaagctgcaatcacctctctgcactactttctctgctttgattccagagcagtgactaccatgggatatataatacccacgtaaattaatatatatatatatatatatattttttaatatctgtctctccaataaagaaaggttaagctctgtgagagcatgagtttgtgtctgtcggtttcactgttatttccatagcacccagaaagtgcctggcagtttgcaggagtttgatgaacattttttgactattaaatgaaagttcttcctggttcctttaaccaaccagtgataatgtcttcctcccttgagatgccgtcgcaggttgtctgtatgcctttctgaactgatagcacagcaaggagactggacctgattaagcaggggaaacctttggctggggatgcaatagacatagaacacagttaatgggctagagaagagacagtggaggctgaaagaaccccgggaacagtcagcaaggcaaacctgggtttctgttctcttcattattaaaggaaactggctgcaagaccctccctttcctttcctctcgattcttgttaccgcagccactttttctgtgcccttattttatggtagtcatttgacttctagaagtcagcgcacggaccacaggctcactccagaaaccacacttccaaatttgaaagccagtcaattcctaaagactccaacttctgcattttttaccaattcctcccctccatagcttccaaaattctgtataggatcaacttttgctttgttcagagagatacattgttctcccttgattaacaaacaattcagcttcaaatattgtttcagattttgagagatagcctcttcctctgacatagaattaagtgaattaatacagataatgccttaaaacagtgtctggtacatattgggaactaataaaagttagctaacagtagtaaataacaacaatatttattcaatacataaatgacaccaggcacggtggttcacacctgcaatctcagcactttgggaggctgaggcaggcagatcacttgtggccaggagtttgagaccagcctggcaaacatgatgaagccctgtctctaccaaaaaatacaaaaattagccaggcatagtggcacacacctgtagtcccagctacttgggaggctaaggcacaagaatcagttgaacctgggaggagaaggttgcagtgagccaagatcataccactgcacttcagcctgggcaaaagagtgagaccgtgtctcaaaaataatagtaataatagtacataaatgcataaaggaaacttgcatgtgatggtaaactgtgacaatagaaaggggaggtcttctcagattgatcaaatgaccagggtaataaactctagaccaagtggctggtgagttatcacctctggaagggcaggaagagaggaccacagtggttgggggttcccctgtgagaagagcagagcttcctccaccatgttcagaacgcaagatggtagctgagtagttcagcccacactgggtaggcagcttcctagaccttctgccttgttgctttccaccttgccctgtgtttacctgtgtagaggttttatttcttataccagattataaacctacagaaaaaagccatgtctcattttactgaccattccagaaacagagttcagcaactggctttcaatagctctctgaggactgactggctgactgtatatttactttggaagtcatcttatctaaccttttcatacaatccaataattccctccacaacctgtggcccagacatgagaagagctgacttctagtcccacttgatcactcccaagttctctgatcctgaaataatacaacctctctgtgcctgttttctcatctataaaaattggagcccatctgaggaaagtgatctgctagcttccaaaaaattcctgggaaaattaatgaagattcagaatccggattcctacccaaaaggattctatgtggagcctaggatctaaaatttcaggaagtattcccatttatattaataatactgaaatacactaatatgcagtgggtatggaaatggctattctgggtgacctctaaagtccttccaaaacttcaaatcttcagttgtctagcccctctctctactcctttaataattatgtatttatcttaaatatgcatcaatctccgagaagttaagaactgaaaaattacaatactacatatatatatatatatacacatatatgtatatatatacatatatatgagagagagtacttactatgtgccaggccctgttctaaaagttttacagatttaacaaatgtaattgtaacaaactcgttactcagtttttcagatgagaaaactgaggcacagagagggtttaattcagttgaattgccttgcccaaggtcacagaactagtgagtagtgaaactgaggtaaatttttactgagtactaaatatttgctgaagttctatgaaggatcaatgagattctgctttatgggtatctaccattagcaaggcatcattagggagttaataatgacagcaagacgaattactgtacttgggtaattgggggcctcaaagtgctgaataacagcaatagaagataataagtgtcaagtagtgccacgtggaagacaccaataaaatatgctgaatgtaaacaatgtagacatttgaaattaagggttgtggttataggagaagctgaggtgtcagggaagatttctgaaattagaagacctgccttctctttgaacatatgcactaataaataatatacttttaaaacctcatcacttctgaagtaacaacttcattgacagctgcccagacctcccaccttgtcactttcacaatggtcacaaaacttttcctgagagtgactccaaatatgcatttctgtcatgtctataggcttttatagtaaatgagttaagtacatggaatttttcttccacaggactgtaatccaaatatgtgaagactttttatcaatgcttttaattgtcagttaaaactgctctcagttttttcagtggtttccgatagtccgtggtctgtagtctggaccaatttgcttttatcttataaaatgaggcatctcacaaaattccaggtgtgatctcaccaactctcaacatggtgaactcatatttcccatgctctggtcaccatgatttcattaataaagcttttattgacaccatagtggattccaaagcctgagctttaagtcctggcccaaattctaactctgcttctgtgaccttactcatgttatttaacctctgtgtgatccgtatttcttttctggcaaatggggaaaacagctatgagtcattgaaagggtcaaatgtggtaatgtgtgcaaggtactaaacaaagtgccagggacagtgtaaagaactcaataaatgataactattaatgagtttcagtctatatgaactctcttttggcactcacgttacactgttggctcaggtagaagtcataattagcagtcttagggttttgtcagaaagtctgccagtaaaagccaagtttcccatccaagtctctttaattgttcagagcaagttagcaatagaaaaataatgtttgctttcaaaggacagaaatgagaaacaatgaatcaaaagtgaatccagacatctggttgggggaggccaaggagctcttcagaaagttagtgcaaagacgctggggaccaagggaggcagaagggtcaggacttagagaatcccgtaggccggtccaagagagtctgagaagcaaagtttaagagctggggtagtattaattaataaattaataagagcctcacccagcctggtgcctgtggatacagaagtaaaaaacagtctctgttctcaagttgttaaaagtctagaaagcgaatatttaagaaaccagggcaaagaaaaattgagatttaaaaaaactgaagatatattttctcttctggaggtttctaagtcaggcatttcttccaggctcaaaagaatggatgcctaatttacctgatgtacctggtacatcagcctcatagattgtttgccacacttttgaatttcacactggttttaaagctattttagttgtcttaaaaatgacatgccaatgagagcgggtaactgtgaacaacctacaaagaagatgactatgggaaatattaagaaataacaataacacaaagccgtgagaacagaagctctgaagctttgggtaatggcgacaaatgtggcaacttagtccctggatctagccctgtgatttgatagaatcataaagaaggcttagggattgaaccatttccacatccaatccacaaacatgaattcaaaggagtaaacagaaaactatgtttacaactttgtcagcaagagatatgggtatctattttattttatttttttttgaaaagagcaagacgagaattttaatcatttctttagtctcatcttggggtcaaattctccttagctgaaatccacagtgagcagatacttctcttactcatactttcatgagatagtcataaaatattgaattgctactatgttcaagacattagggcaggcactatagaaaacttcaagaccaaaaagacacacagatggtgaccccaaaatccaataagggaaattagacatgtttattaatacttgaaatcctatccaaaaggcataaagtttgataggtgaagtcagataaaacatactgaaatttcagagaagggtattgtttctcaatgtgagaagcaggaagtccttctggatgaggtggcatttgagacagacctccattcatccaatcagcaaatacttatatttagtgcctattatgtatagaactctgtgtaaggcatttgaggttgagcaatgaacaagaaaaatttacatttagttggggtggataatatatgcagttaagacaaacagataaattattaaaataatgcaggctataatgttctaaaggaaatacctgaatgacttcatagaataaggacaaggagctattgtagatataatttggaaaaaatgtttctgaacagaagatatctgaattgagttgtaaaagagaaggagagccagacacgaaagatatggaaagagaatgatccaggaagaaggaacagaaaatgcaagcaatcaataagctggcttctttaagaaatggaaagagataagtgtggcccaagtgtgagggcaagggaaaggaagggtgaaattagatttggaaatagggactgggagcagatcaggtaaggtcgtattttactctaaaatcaacaagaagccacttaagggttttaaacagaggagtaacatgaactggcttacatttatggaagattcctctggatgccgtgtagagaatgaactgtcaaaagacagatgtggaaatagggagactgcttaggtcacaactgtagaagtccaggcagtagacaatgggaactttggtctggatggtggcagacgagatggagcaaagtgctgcaacttgggagatatttaggtgataaagcttaaagaacttgcggatagattggatgtaggggtcaagaaagcaaaagaatttaaagtaattcttaggtttgagacccgagcaatgagacagatggtgactagtgaaccctctatactgatctggggaatgctggggaaaagcaagttagacaaatgtgtggctgggacataggaagatcgacattttgacaaattcataggaattggtcatgatgacatagagacaagattcatgccatggacattcatgacagaaaaagcaacatggactaaggcagaaaagtgtgtgtgtgtgtgtgtgtgtgtgtgtgtgtgtgtgtccaagaaactcaagtacttctgtttgtccaaggggcagggtctgtaaatgagggaaggagcttttgagaaagaggcaaggagaccaaccttgcagggacttcagtagaaactgaggagttcagctgttacttactgagtgggcaataggaggccactgaaagctgttgatgggataagaagactgccttagaaagatgaagcgggactggtgtaaagtttaggtgtgaaaccaagaattgaaggaagagagaaatgatggcaataatccaggccagggagagggaggaaatgaactaaatagtagacaggatggtaggtttacattttattttatactctctcctacaataccattactgaatttgagccaggtatcccatatctttgtaaagagttctacaactgtcaatggatagacagcttttctctcctccagtaagtctatgttctaaaaatgatcattagataaaaagtgacagaataagatgggagaaaatcactctgtgcatcagcacctttcttgaaaagcacagatgaacatgtaatatttctgggagggaacatgttcccgtcacccagagttttacattatgagactacgttgtgttagaatctcagataccactcagataattctgattctactgaaacaccaaggcatccccacaaaccaaagagccaggtccataaacaccatccagcttctgagagaacgtgctcctcagaagggagtctctgaaacagccagaaaaatagctggcagtgtcctaccaatagccaataaatacatagtacatcataaaccctgcttattttaatttcagtaatgtttttctttcactgggcacaaggccaggaattagataacctaatcttttcaagagagtagatttttcagagacacttactcctattgcttgagtaaatattacttgataaggggcatgacgtgctgcaattgtatatcttagattgtcatattaataaggcagctctccaaaccacctccacccaccaaaccatttctaaatcttttgaacttctataatgggtacaaattcagcttgaaaacacttatgcaattgggctccatgaaaaaaatttgacttaacatagccatttagtaaattttatccctgtccttcagtcccagtttggagcactttactcgatcatatcctttaatgtggcttagtggtagctactgcaccacagagcagtattttcctcaggagctgtatcttccttcttctctccattaaccactgtcaccccccatagtcatagtttctgttggcattttcctcctctgacatcttggctgtttgtcctttcttattcttcatccttttcttgtctatatacatttataaaacaccaggtttcactcattgctttaatggtaacttctgtgttttctgagattcagggctgagtaaatagaaggcctgtttttagtttgcttgtttacttgaggccatttttggtctaactagcatcccaactagaaccacccttcccctaggacatggtcttggtgatactgtcagttaaatacccttttgtgggtatctccaagttctaagttttccagatctcaagtcaccttggttcctgtcttatttaagacctaattatttatctttctctaattctgtgagctttctaagatactctcaataaactcccccttttggtgagcaagagtcattctgcactctgtgaaactagagagccatatgaatactctgagtagcttggattctgtagccatttccaactgatgaaaattaaaaccaactagacacaccttactaagtatactctcttgaccttcagagtctctcatctatttacactgttttccaaaacttggaggtcaaccagttactgtcagacaataaatatgctgttttttttctaactttcttcccatgtataattctggatgcttgaggtcagtgtgtatagtgcagtcatagcaaaaagagtccagggcagtgctgccaaaaagaaatataatgcaagccactgacacaagccacctgagtaattctatcttctctagtagcttttctagttgtagtgtggcataaatgaaacaaaaatataattgcacttataaaataataatggttaacatttaatggatacttacaatggaccaggtattgggatatacactttatatatttatatacatatatatgaggttatttcatttaatcctcataactgccttatgatgaagatatctttattaactctattttatagataagaaaactgaagttagagaaagagaattgcccaagtcatatagctagtaagtggtggagccagaattcaaagccaggcagcctgattccagatgccatgttaataattaccatattctccttttttccaaaaaaggcaaggaagaacatattgctttctgtgtcttatcaaccacactaaactatttggatacatttttgtactcctaaagcaataagcgattatcttagaagtatgtattaaattgcaatgtgttacaattaatatatagttttaaaaccaatttgctcaagtgttgactacaggactttaaatgaattccatttaaccagcaatttaaatgaaaatttaaataaatgctataaatgggtgcctcatttgcatcatctgttgatttactctgatatggggattatctttgcccagggttctgcctccttagggctttggtgaatcattttctaggtgaacaggaggcacttactctcagctctcttgcttctcaatgcacatgttgtaacattcacatgtggccaccttcagatacagaaaactgtacttaccaaattcctttagagttactaaatgtgattggaaagtacatattgagaagctcattggaatggcagtaaaacctttccaaggggtacatttaaattaaaacagatggtccaaactgccttctagggagggaggacactgttacctgcaagaaaaatgcattgctgagtagggtttgcaaatctggggccagagcttgaatttcttagtgaagtaggtagtgaagagggtgaggctgaaactcatccctttatgccacacagattcagcttcacctctatataaaattggagcaaatgtcctaaaaattgtagcttcctgggagtcatcacagtaacacaaactacattatagattgtaccgctggagtggcaaatgcaggtgccctgaggaatgcccacacatctcactgctactgtaatgttgagaaatgaagtactcgcagaacactgcctaacagatcatagtgacactggcctgggttattcctcagctgaaactcactgagagatgggtttggaaccatctaggatatgggccaaggatgtttttggccatttatgtgtaagattttgggatcttagagctttacaagcacttacagatcagttagcaaatgtcctcatgttgaatttgagagaaccaaggtttgatgacacagagattgcttgaagcctgtgtaaccccttctaaagattcaccagatccactaagtgttatctacattccaccactcgtaagcatctagaacctatttcatataatcgtagctagcatttatttagtgcttactctatgccatgtttttgtaggtcctttgtaaacagcagcacatttatacaaaacaacaactctttgaaaatacaaacaactaaactcactctggttaagtaaagcagaaaaaaacctgcttgaagggtatatcagctgtctatagttgtaccaaaaaaggaacccaaaatttagtagcttaaagcagcaccaacgtacataattgcttcggggtaattctggtcttgcctgggctcactcacacaactgcatccaacctgtgcattggctcagagctcagctcagccaggaagattgagatggctgggtctttctatgtaggcttttattatcaaagagataagacttgtcttcctcataaagtaataccagctttgaagacagtgaaggcaaaagctacagcacctcttgagatctcagatgatttgtcataaatatcacttctgctgtctagtggtcaaagcaagtagcaaaagcagccagactcaaggatatagagaaaaaaaaaaaaaaagctcacctcttgatgacagaaggcagttgtcacatcattgcaaagtggtaagcatactaggaagaaaggattctgaaaccaattttgcaatctatcatagtccagtctctgatcaaaattcatattcctctcatccacaaaatatcctcattcccatatgaggaccttccaaaatcttatctcattatagaattaggcttgaagtccagaatatcgtggtctgtgtcttgtctataggcagacaagactgttcagttatgttcttggtccagagacccctaaactaaaaacacaagttatcagatgtcgcacacaacatacaatagtcatgcaggccaggataatttctgcagacactctcacgaaagaataggaggcagagggtaatcactgtcttacagcagttctgaaatcccgctgggcacatacttcacatattaaataggatctgatttgccctctcgggtggtttcctaatccagtattctctgtggcccttggctccacactctggcagaagtgaagcagtggcccagcctctctgaagtcaaatgccgtgatgggtagatacagacataccagcatattgcagtttatcctcactctcttctcatctagatgcttggttattgatcctagagatatcattcacacacaagaaaaagcttctccagcccatttcactatcacagtttggcaattggacacgcctggattaccagattttcctacaagctccaacttggccattcttgccagttcctcaggaagctgatccgtgacttttctctgatttccaattctcccttatgaatgttttcttcagttcctgctacaattgtgtgtaaggtctaattcctataatacattccatattctataatgttctatacatataatatgttactgtatttaatcttcacaacagccatgcaagttacatactaacatccccgttttataaatgaggatattaaatctgagagaagttaagtaacttgcccaaggctacacagctagaaggtatcagagatcaaattcaaataggtctatatgattctcaaacctatgattgtaacccctattttccatttatggaaagagatgggatagggacagtaatgtgtactgataaattggtttctgaagaaaaggctctgattggtagcattcgcctatttctatggtgtaaagacgccgatcatggctaatttcagggccaattttaaaactggctcacaacatttctgaatatttaacacttgtaatgaacaagtatgaggtggtttcagcatgcctctgcatggggagccaagaaaacaaaagttcatcaattgaaaaaataacagaaacggagtagagtgtttcttcaggtgtctcttccatgcacaggctctctaatttccaaatgttagcatctcatatttttgcctgcagcctattttggtcagaacctactcttgcccacttacatgccaagtgtgaagatctaaaaaataaatatccatagctcagcatccttcaaccaataagtgatagaaactgatgtattaatagccaactttcttgttcttcacatgtggtaacactaatgtctgtcttcttcattaacacccagagttacccagcaggattaagctttagttacccacagtgagaaataccttactttattatgcatcctctattggctgtctccctgaaatcaccttacaaactaactaaccacactctaattcttgattcagagtctgattctgaaaaatctaacaaatacctattattttttgaatcccaatggaccagaaagacactgtactaggcacttatattacacgtttttggacaaatattcatagcaccctagaaggcaagtatacccagttctacaaatatggaaatatgaggatcagagaggttagttaactctatggaggtcacatagctgatatagtaaatagcagcgctgatattcaaattatgatcaattgtaacatctcttctctttccatgaatctatgcagcctctctcaccagaaagattgaactaacacacatgaaacaataaaagaacaattaaatgctaagctgacatattgtattgaacaattttgggcaaaactgtcatcaaacttatgttccgcaattactttctaaaattctcttttttgtgccatcaacttgaaaaataaggccactgactaatattagggaatccaatttttcataagttttctttatcctctatcactgcatcatacaaattaggtactgaaataaaactgagtgtcatgacagaatataccatgatgaaaatgcatatgaaggaaatacattgcttgggtatatttttcggcccacatagcatctgaaaaatcagatacatcataaaataccaactaagtctctattgattttgtaagtcaacacaaagtattaaaagatcaaacaacacagcatacagagtgctgaaatgggaatagtcttatcagctaacaacatcagcaaaggaaggactttgatttgacttttgtctgttaaaggggcaaaatctgaagtgtggaaatttaagatggttaatggtgtagtattaccatatagattttaatatttaaccataatagattttaatatttaacagtggcttgctgtcatcaagtaatttagatagttgctctacaatatttaacatgaagaaggtcctgaatgctgaaattattagcactacaccaaaaaatctcagatgctggtagaaacacacataaattccaagtatgatttgatcagtgtcttacaggttttgtttcttacttttaattacctgtcctggtgatatgcacaaaagggaaccctctggagtttggggtgagagttttagccctgactctggcccccaagtagctctgtggctgcaagtactttaacctttctggttaaatgatactctcagttaaataatgctctacaaaacaccttgtcactctaacaatgattctatggctaaagcctaattttaaaattaagttcttatttacgtaactaacaaagatcacattctaccatttctaaaagtggtccttattagtgctcttcagaaccataaatttctaaaatcgtccaggaccttcatggaagtagctcagggaaggaagtgatggagaacatgagcaagtagtctttttggcccatgaggcctactttaggtatagaaatgcaattttaactgaagtatctctgtaaattattttccttaaacaaacaggctggaatgaatgcatgaatactttggcttaaattataatatgactgatagacatttgatacccatctcttttccctcttcataaaatgcataacttatctactgagacttacttatcacaggacactccactcagaggcctgagacccagctttgaacatatttacctttggcaactgcacttatccaaagacagtgccagtggcagtggcactagctgaagcagtcaattccatttgttttaagcgtattgtggtgctatcatttttatgacactagggtatatagagaaaatatagtatccttattatgttctttaattaatcctgtcttccacatgagcccacattgctgaaaaaaaggtaacaacatttattttatttagtccaatctggttaaaacatgatatatagtaagttaaacagttcgtttaggcaatgttctgtttaactgtgtaaacatgtttgatatctcagatttccacttctctgaatacttttcttgatgacttctaggtatgtggggagtaaagaatgtctcactcaacctcagagtggaggaagagtggtggagtccttggatcactgcagtgtgtactgactggtacctttgtccctgggcaatctcacttgtctacatctttagagcattcatacctggctgtcatgtgggatgcatactcatggcttcttatctctcatgttagtcagagactggggttctctctgaatgaggtggtctcactttagcttttggtgatggtatagacatttctgggcttatgccccatccttccttggctccccagtagagaaaatgcatcccatagcttttgccttcatcctcatcagagaaagcccactgggaggaccaagggtactcaattaatctaccttcctctgaggacaaaaaggcttttctgaatcatttccaccccttgaagagatcaatacaggctctccctctctatcctactttagtgagccatcactttggctttgataagtctgcaaggtgatctcctccaagagaagctgataaaggcctatgttgttgcttaccatatttccataaaactatcatataaccatccactgtctctccacccctgcttccatcccaagtaataagaaatcaagaatgtgaatttctgcactcgtctctcttgcttaatccttctttctcttctcattgtcacttcctgccagaaatggagatttttccgtgactttgcctgcattaaatattactttttcttgatgctagcctcatgggtagccattgaaggtgcacaaaaatatcttttctgcaccaggaaaaaaactctgtaattttgttctctaggcaaaattggttaagttaaagggaaaataaaagaatgtagaaagcccaaggcaatagtcggaatgataaaattattgttttgctttgaaactcctattttgactgcctgaatcta

SEQ ID NO: 1657 - DNA, 13601 bp, Homo sapiens
ttcattgtttctatttcttttgttcctttgattatctttcttagaatgaaatccttttttattttccactttattagcttatttttacaatattttgcctttacttttagcctaaaaattacagcatgcttccttgttttaatatatttatataaattagtacatttttcactttaaacaacataaggaccatagaacttctctcctcacttgccccactattaatttatttttattttttcctaagttcctagcttcagtgttatattgtcatgcattttaattttatatttatctaccagtatcattggtttttattcctccctgtatttctgtgttttcagttgcaattattttcctttgcaggaaaaaaactcactttacttgaagctgctgacaacaaattctctcaatttttttgatataaatttttattttctttttatttggaggatgttttcttttaggtacagcattctagtttggcagttttattttttagctctctagtaacagcatcatattatcttctagtttccattgcttatgttataaagtcagctatagatgacattgttgctgtttcaaagataatgtgccttttgtttaaatcaaaatattccctatgtatttgactttcagtaaattgaggtttcatttgtatatattctgctttaggtacatagttccttttaactttgagctttcttgtctcattattttgggaaaatttctagccactgttttcacttaacgcttttgtttccttcttctcttacctcacatcatatcatcttacctaacctcactttctcttatttctctctttccttttatttgggggtatttagaagagatgctaaaccttttgatcatgtctaataaatcttgtatgctttgtaatgtatttttttctgttatctactctattttctgatgactcatcttcctgttcactaactcttactctatgttcttaatgttatttctagaattaccatgtgattcatactatcaatgcaagaagtctgctgacagtatcgtataccttgttgtatacattaatcatagttatttaaaaacatctaaaaagtccaataacccttgtttttttttatcactgggtttcagtgacatagccctgcatccttttaaatctgctagtttttgagaaaatgttgaatacagtgtatgaaaagttagaaaggtaatctgagattttttaatgtaggtattttcagccataagggattctcttttgtttttaggaggcaggagagtaggagcaaatcaatttttttttttttttgagacagagtttcactcttgtcgcccaggctggagtgcaatggtgcgatcttggctcagtgctacctccacctcccaggtttaagcgattctcctgtctcagcctccctagtagctgggattacaggtgcctggcaccatgcccaactaattttttttttttttgtatttttagtagacatggggtttcaccatgttggccgtgatggtcttgaactcctgacctcagatgatccatccgcctcagcttcccaaagtgctgggattacaggcatgaaccactgcgcccagctggagcaaatcaatttttatcagcctgtgataagattgattcaaagttggatttctgcctttgcaaatgggcttatttgggtttgctctaatgccagttgaaagcctgaagtgtttaccgaagcccatcttctttggcaggtcttgaactaaatgtttgtctctgctacccatgaaactggcaaacctccattcagcttcttagcattttggctaaaattaaaatatcagcaaatgtgtagaaaagtgccaagtgttaggctcccctctcagcactcctcttgctttctgggatcttggtgcctcaagttctggctgcattggtaaacatcaatccttattttcacttttcttatcccaagatactgcccaaagctctgattgacttctcagtatctggaccctttacataaataagcaagggaaaggtggcacagaaatttggcactgcttggtataattcttctctgcaagttcttggtttctcaagggctggttgctgaagtagttctttaatattttataataattaaaaccatttttaaagtttttataattgttcttcgtgatctgttttgtcttctataggccagtctttcttattggattatagtgattttattaggctatcagtaagtaaacaaggtattttttaaaggagacattgaatcactctataaaatatgaaataaactctttcttgattaaagtctttggatacaagctttcaattctttgcataataattattgtaaaatatgataacacatgcttgaaaatgaaaagactaaaatataaagatttatttgttctatcccctgaaaagacagcactgattctatcacacacagatataggtatttatcttcctatagatcatacctaatattctcagagttgataatatattagagaattataatgcatatcatatatgtatctctcaggttacagaaatttcaaatggtgtagtaaaattaattttttgaggtccaggagattatcagattaactgaatcataaggtgactcacaaaatatatgagagtaaacaattatatatagtagaaaaatatatctgaatctgcattcatttttgaactatgtatttactctacctagatgcaaatcttttccccagtctgcctgtttcccatattattcccatattatatgtaaatatttctatatagacatgtatatagaaatatataaacatacatatgtatcagtctgcatatttatgtatgtgtgttagtctgcctgaagctgctataacaaaacatcacagactgtgtagcttaaacaacagaaatttagtttctcacagctctggagtttggaagtccaagattaaggtgccagcaaggttggtttctggtgaggcctctctctctctccttggtttgtagaaagcaccttattgctgtatcctcacatgatcattctctgtaagagagagctcttgtctctttaccaactaaaaaggacaccagccctgtttgcctaacaaggcaaatttccttagatattaaggctcacgcataatcctctttggtctgatgcgctgccttttgggtccactggggtaatagcgtcacctcccctactctgcacagaagccccatccctgtggcctgggcagccctgcccctgaggtactgggcagtggcattctgccctgctgaaacccaggaggtggccctcttcctctgagaccaaagagaaaacacctttgccttgttgggtatgtgatgggagtagcaactgtgctgctctctgaatcactttcagggctgttcttcctatttcttgaaggataatgcatgtttgaagccagttaattctattgtcttgttctgcagagtcccagaagtctgacagccttcctttattacatccaattctctctgttttgtttattccagctgtcagtgcttctgctgatgtaattccatctccgttcctgtcctcagcagagatggctgattaaatccataggtaatctctttaaggagcaaatttccagccacacactttgtctctctagaacatgctttccactttttgcaacatagttagtctgataattttccaaaacttcaaatttccagccacacactttgtctctctagaacatgctttccactttttgcaacatagttagtctgataattttccaaaacttcaaatcctggttccatcttgcttaaaaatttcttcaatttgtatatcttctctcacattttactctaagcaataaggaaaaatccagcctcaccttcaacactgtgcttctacatctcttctgccaaatatccaaggacatcactcatattttaccttccacaagagactagaacacaattcagtgaaattctttgccactttatggcaagactgcctttcctccaatttccaataacatatttctcaccttgagacctcaccagaagcacctttgttcatgtatctaccaatattctgtttaggataatataagtattctctaagatgagacattttctctaaagatcttcttatttatctgtatatatgtatgtgtgtatacatatatacatatacacatatacatatatgtatacatttatacacataaacacacacaaaaattctaaccttcagtctgacatattagatgggatctttgggaggcaattaggtcacagggtggagccctcatgattgaacttagcacccttataaaaggaactcatagttctcttgccctctttctgccatgtgaaggtacaagaaaatggcagtccgcagagagcactcatcaaaacctgaccatgttggcacagttatcccagacttccaggctccagaactgtgagaaaataaatttctgttttttataagccaccttactctatgaaacgttgttatagcagctcaaactaagatagacagacagatagatacgtagatatatagagagatgatagcacatttttaactggaaacatcatcatctttttaactcaaaaaagtaaaagatgcattcttagtagaattattcttacacaggcaagacatctgcctctatcaattcaaatgtatagtctaacttcagcaagaatatctctgtaggggtaattgtaatatctggtaaatagtaagcataatttatagcttaagagagatttacactaatttatacttgaccagaaattaaaaaaatatgtcaatgaaaatattgttacaataaacaactcaggaaatgggaattgtaaagctcagagcatggctccctaagtttcatttaagtaagatcagaatttttggaatacttcattttaaatcatgcatattcagaacactggctaatggaataaagtttagtaatatatttaaatatgcagtctcaaaaatgttgtcactatgaaacatacaaaaacaaccaggagtatttaacttgaatacacagtctaagtagatgtacatatacataacccattacaaagtcctaaaaccgaaatcacttcattttatcagtagagtctgaaggccattcagtcatttgtttttcccctgggatattagcactattgcaaaacccaaaaagaatattttttccacaatctaatttttttgactaatctgtttgactttctgacattacatttgcattttttagtaacctctacagttataaaacattgctttttagatgaattcataataaaaattattttaataaaccttatgatatgtttttctcgcattttcattgttcgcatgcatagaaattgcttcctattccatcagatcttctcattttactggggtatttttaagtcagtttgagtagttgttcataaacttttatttttataaattgtgacactcttgtgggtaaaatttacactttaactaggaatgatggttcactatagaatgatgcttttctgacagttgttgatttgagagcatgtctctgttaactttaattccatctctttttttccctgtaatgctcaaaatgccaatacatcttcatttaccggttgaaaattcctcttcccaaggcaccaagggtctactaaagagtatgtcactaaaactgttgcatttttgcaagcttgggcatcacatatggctcacgctagactcagatagctgtgtggagcaaatgctcaaatctgtgccagaatttgttcattttaacatcactgggactttcaaagaacaaatgccatctatgtgaaaataacacactattaaaggatttaatagcgttactcataatggttaccttaatgataatgctgaattgatctattctgaaatttattccagattaaaacatcttgatagactgttgctgctactgctactgctgctgctgctgctgcatccctagatttttcttcatatggctataacttttgatatgccaataggaaccatatcagtgacagaagaataaggatgctcgtggaatcctcagggatagaagcagcagtgtgtagcagctggagtatgaaggcttatggcagaggcagcagtgagtggaggcagagacaaaaaggaaggatccagggtaatgcaggattagcaggagagatgacaatgttaagggacagtttaggggaaaaagtagaattttgttctaaataagctgcatattctgatttcagtgctcagtccattgtatttttttaagttttaaaaaaattccaagttatattttatttcctcattcataatacaataataagcatatattaatatttaatgtgtgtgttttttatgtgtatttcatgccctgggtctgttgtagatattggagatatagtgtaaattaacaaaatattttaagaatttcttcctaattgaaggtggcattctggtctatgaaatcatatactatagaacaagcatatatattgtcataattattaatacaatgaatgtaaaatgcttagtgaagtacataatgtaaatattaatctctaaataaatgtaacattgttatttttggaaaatgtgtatcactaatgccatatcaaagagctaaaaactcaaatacataaatcatcttctaaaacttgccaatgaatattttatacaatgtttataaattaatgttaatatttatgtataatgaaatgcaaagctcttaagtgtatattaagatgaattttgacacatgaatgcacagtacaagtaataaccaaatcagaatatagaacatttccatccccagagaatttcctcatgaccccttcctgtcaagctcttctctactcaagccctctatatttatatttctattcccataaataaatctagcttgttctgtaacttcatcacaatggcacaaatagtatgtatttgttttttttttttttttttttgatctggcttttgtttttttttggtctggcttttgtttttttttgagatagagtcttgatcattgttgattttattactgaatgtattattgcattgcattttatgaatatactataatttttaaatcaattattctattaatgaacacttggtagtttctagtctttgactcttacctataaagctttctaaatatccttgtacaagtagttttgtaaacatgtattttcactctttagtaaatacctagctgcattatggtgctttgtaggaaactaccagatacttttccaaaatggttgaaaatcttatacactaccagtatattaagagtttatgttgctgcacttcctccacaactttagttgtcatcagttgtttcaattttaggccttctagtagataaaaggccatagtcatagctcattgtagtttcaatatttgtttccttgatgactgatcaaataagcacctttttatgttcttacgggacatttgtgtagattttgctcatttttcaccaggtttgacttttttatgtattttgcatacaatttgtcagagagatggtgttacgggctgaactgtgtcccccaatatccatatgttgagacctaaaatccccaatgtgactgtatttagaaaggtgtataaggacgtaataaacgttaaatcaggtcatgaaagtcttaatctaataaaacttgtttcctcataaaaagaagacacaccagagatttctttctctttctgaacaggcacagaggagaggccatgtgaggacatggtgagaaggcagccgtctacaagccaggaagagaggcttaaccagaaaccaattgtggtggcactttgaagtttgacttctaacctccagaactacaagaaaataaatttctgttgtttgaaatacccaccctgtgatattttattatgaaagccctagtagactaatacagatttttagcaaatacttttcttttaggctgtggcttatgctttcaagggtgtgaagttatttcccctattttttcttctagaaactattattttaagcactctgcatgtatgcatgacccatgcgaaaatattttttatatgatgtgagattttgccattaaacgatcacagcaactttgttgaaagccacttagactgtgcatctactatagactactaagtgtagacttcctactctgatccattgttctacttgtttattattatgtcaataacaccatcttgattaatgaagctatattataagccttataatattttatttttatattttaaaattatatttacatatataaaacatttcatatttacataatataaaatatttacgttttatcatacttttatattaaatttaaaatttatattttatgtagttatatattaaatacataaatatataattcttattataagaaatcaggcaatgtatgtcctccaaatttatggttgcttttagtgttgttttgactattctaggtcctttgaatttccagaataattggttagtccatttgtaacaaattggttgttgggattttttattggggtttctttgaatctatagaataattggataacaaacattctaacaatatataatcttccaatccatgaaaactatttgtcttgccatagaccttctttaccatttctcccagaaatggttttaatgtttagtgcagatatattgcatgttgtccactaaattcattgctatgattttattgtttttatgccacagcaaatggtattgtgcttcaattaaaattttcacttgtttgttgctgttacatacaattgttcttttatatattgaccatgtatccagtgaatttgaaaaaaaagttattacatttataaaatatatttctcaggatttttcacgaatccaatcatttcatgtatgagtaaagagaggcttagtttcttttcagtcacgattttgctggatagcactggcaagacctctaatataatgttaaataaagcaatgagaactcacattcttgccttagttcaaatcttagtaagaaagcatcaatattctgccattacatatgatgttagttctaggtttttcagaaaaatacttcatcagatagaggaaattttcatttattctcattttactctgagctattaacatgactagatattaaagattgtttaatgatgtacccataatatttctcttttattagagtctcattttggattaattgctcttcaaaagttaaaccaatcctgcattcaatagataacgttccacatagtaatggattataatttatacttattattggacgcaatttgcaaatattttctttaaaatatttttatctttgtgtgtttcactgaatttctagatgtataggttgatatttttcaccagtttgacaagttttaagccattgttacttttaatatttttctctcttctcctagaaccacactcattgctatattacttgatattttcctatatattactagatcttcatttaattattttattattttggaagcttcactttagatcatgtctattgacctgtcattgatttcacttattcttttttctttactgtctaataagctgtttaacccattcagtgaattttctttcatttattgtacttttctagtatttccattttctttttatagatttcattcttttgcaatttcaaaattattctttcatatgtccaaatttttatttactttccttaaatatattttaacaactgtattaaatcctttttgttaactcaaaatcgatctcatctggtaatccatttttactgactgcttttgctgctaagtatatgtcacattttcctgtgtgtgtgtgtgtgtgtgtgtgtgtgtgtgtgtgtgtgtttttacatagctagtacattttttgaaattctgcacatggtcaatgttatcttaaaaggagagataatttctttctttatatggtactggtttgttctgataataaaaccctaacagatcttctgtattttgtttagctttagttatgatgtctttatttttgttaacttcttaattcaacggttatattctgattcaaaggtggtgtccttatccctataaaactttctgggttcttacgtaaatttccaagggtaggctagaactctaatggctccagtactgtatgacctcttatagtttccagtcggatctgagctgaacaggagctattgtctacaaggtaacaagcaaagtgctcagcatgaacatatgaagctcagttattaggtaagtactctcaaacatttccaggaagaattttggaatccttcttttgcagaattatgtatcttctctctctctgatcaaattctaggtgttttggtagctccaaactaatttttttctccatatcaatgtgcaccagacaatatgttaccagacaaaatgccagattgaatgtggagctcgtctgtatgtattttccttctttcaaggatatttcaagaaatatacatagccgggcgtggtggctcacgcttgtaatcccagcactttgggaggttgaggcgggcggatcacctgaggtcaggagtttgagaccagactgaccaacgtggtgaaaccccgtctctactaccaatacaaaattagctgggcgtggtggtgcaggcctgtaatcccagctactcaggaggctgaggcacgagaatcacttgaacccgggaggcagaggttgcagtgagcggagatcgcgccattgcactccagcctgggcaacgagagcgaaacttcgtctcaaaaaaaaaaaaaaagaaatatatatatatatatatgccttatagctaacttctagagtaaacaatgataaagaaattagaagcagaaagataaagataaatttacttcaaagagccaacagatggtagcaaacttcttcacaaaaatatattacaagaaacagagtcagataaagtgttcaggtaaccaaaaattgagaaattcttccacaaggagacctctcattctaaaaaactttgaagatgggatatttgatcacaagaaaaatttttcttgatgaaattgttgagatataagaaaaaaatggaaaagaacaacaaaaggttatagtatgtgagtgaatttaaataaatattgatgatataaaataattctcgttgtatattttggagttcaagagttcaagagaaagaataaaagcaaagtagaattaagataaaaataactgctgcaaagaagcttatagagataaatgatgttaaaatgttcaaagatcttagatcatgtaagaggaggaaaaacattgatagacatattataaaattaagcaaatatatttcaatgactagagtagcatcaaaaccattggaaacagcatacaactttcaaatagataggagtttcctgtggactattttggctgtaatttctgctattttctgttcaaagtatcttattttctatattctgagttactttaaccttaggctgatcattttccttatgattttatttgtataaacatttaagacccaggatgatggtgggtccctacaggaaagatgtgtaaatgtttctaccatttgctttggaattgcaagatatgtcaacatatgtaaagtgtcaacaaaataaataaatgccatatgtgaaaacttttaagtaaaaacattattgaaaacccaaaaacatacagatacacagtttttcaaagaaaacaatgataattcagagcacagactttttaaaaatagttgttacatttgtaaagtaagttatatgttaagaatcacatacaatataaaataattgaaaaaaattgcataatggcacagagaaaaatgttgatccttgtacatattatcagtacagtaactctattctacatgtatataaaaataaaaatgtaaaaatttggattctagatatttactggagcaaaaatattaatgctcagagcagaaagttagaaaactcagcagttttataactcatgaaacatttttaatgaaacagaaatgtaacattatgaaatcttgagatagtagaaatgaagtatgattaaactattttaaatttaaccaatattcatattcatatatgcattgaaaaattatacctttttctaagtttgattcttgaaaattatagttagttttaaattatttattttttcagtgattttgtcacatttaaaattcccccttgaaaaattgctttattaaagtgaaatatttgaatatggagtttgaagagtaacaaataatttttcttataatcagttgtaaaacatatataattttcaacattagtttagtatctacatgtattttaatcctataaaagcaatatttttattgtaaccagaaattagatattcataatgctaacagatttttaaatattatagctattagtatatataacttaaatatttctaatgtttgaaatttcctataaaactggttcttaaacccttcaactactagaagcctttaatgcagattgataaatgtgtactttacctaatttataataaatatggcatattaagtacattttctttcttgactctatatttccagaattttaattcagacttccataagaatcaggaaattatttactttgacctaaattaatttgaaactccctacaatggtactttgtgaacttcgtgtttttagttatttcagtttctgacatttgtgtatcaatatttttaaagttagtccattttcttacatgtgttctattcagcatgcttccaccaaaaaaaaaaaaaaattaagcaattatggctttcttccatttagattatgtgggcaggtctgtgggggtagtacagaaggtatatttcatctcaaacataaacaggaagccaatgtgctatggaatgaatgtttgacccctgtgaaactcatgttgaaacttaatccccaatgtggcagtattgagagatgggatctgaattaattaatgtaaattccagtagactcaacacactggcatcaaccattataattacaacaatttttatgaaacacttatattttcaatacctgttatcctttttgaaataataaggacagagaatgtaaaaggaagtggaaaagcacagtgtggttaagagattcataaaattgtgcttggattataaaacactttaaaataccttgagacatttttgaaccaaagtttgtcagaaatatctatacacatgtaattaatgacaactataagtaagctaagacaggctgggctgagaaggtggtattaggttttgggggcagaagtctttgcagaatgtaaagtataataggatagacggtatttcagtggaaacctactgattttttttgttttcctgtattcctttcacttttctgtctgtcactcttatttctttcaatcctctttgagcttttttgctcttttccttttatttctccactcttgctctctcaccctctctctcacacactcttcttcccacaattccttcgtccctctttctcctttaccacatccctttcagaaacctttattgaagatatattatgtgaaaggtatgaggtattcaca

SEQ ID NO: 1658 - DNA, 11415 bp, Homo sapiens
ggccagtctttcttattggattatagtgattttattaggctatcagtaagtaaacaaggtattttttaaaggagacattgaatcactctataaaatatgaaataaactctttcttgattaaagtctttggatacaagctttcaattctttgcataataattattgtaaaatatgataacacatgcttgaaaatgaaaagactaaaatataaagatttatttgttctatcccctgaaaagacagcactgattctatcacacacagatataggtatttatcttcctatagatcatacctaatattctcagagttgataatatattagagaattataatgcatatcatatatgtatctctcaggttacagaaatttcaaatggtgtagtaaaattaattttttgaggtccaggagattatcagattaactgaatcataaggtgactcacaaaatatatgagagtaaacaattatatatagtagaaaaatatatctgaatctgcattcatttttgaactatgtatttactctacctagatgcaaatcttttccccagtctgcctgtttcccatattattcccatattatatgtaaatatttctatatagacatgtatatagaaatatataaacatacatatgtatcagtctgcatatttatgtatgtgtgttagtctgcctgaagctgctataacaaaacatcacagactgtgtagcttaaacaacagaaatttagtttctcacagctctggagtttggaagtccaagattaaggtgccagcaaggttggtttctggtgaggcctctctctctctccttggtttgtagaaagcaccttattgctgtatcctcacatgatcattctctgtaagagagagctcttgtctctttaccaactaaaaaggacaccagccctgtttgcctaacaaggcaaatttccttagatattaaggctcacgcataatcctctttggtctgatgcgctgccttttgggtccactggggtaatagcgtcacctcccctactctgcacagaagccccatccctgtggcctgggcagccctgcccctgaggtactgggcagtggcattctgccctgctgaaacccaggaggtggccctcttcctctgagaccaaagagaaaacacctttgccttgttgggtatgtgatgggagtagcaactgtgctgctctctgaatcactttcagggctgttcttcctatttcttgaaggataatgcatgtttgaagccagttaattctattgtcttgttctgcagagtcccagaagtctgacagccttcctttattacatccaattctctctgttttgtttattccagctgtcagtgcttctgctgatgtaattccatctccgttcctgtcctcagcagagatggctgattaaatccataggtaatctctttaaggagcaaatttccagccacacactttgtctctctagaacatgctttccactttttgcaacatagttagtctgataattttccaaaacttcaaatttccagccacacactttgtctctctagaacatgctttccactttttgcaacatagttagtctgataattttccaaaacttcaaatcctggttccatcttgcttaaaaatttcttcaatttgtatatcttctctcacattttactctaagcaataaggaaaaatccagcctcaccttcaacactgtgcttctacatctcttctgccaaatatccaaggacatcactcatattttaccttccacaagagactagaacacaattcagtgaaattctttgccactttatggcaagactgcctttcctccaatttccaataacatatttctcaccttgagacctcaccagaagcacctttgttcatgtatctaccaatattctgtttaggataatataagtattctctaagatgagacattttctctaaagatcttcttatttatctgtatatatgtatgtgtgtatacatatatacatatacacatatacatatatgtatacatttatacacataaacacacacaaaaattctaaccttcagtctgacatattagatgggatctttgggaggcaattaggtcacagggtggagccctcatgattgaacttagcacccttataaaaggaactcatagttctcttgccctctttctgccatgtgaaggtacaagaaaatggcagtccgcagagagcactcatcaaaacctgaccatgttggcacagttatcccagacttccaggctccagaactgtgagaaaataaatttctgttttttataagccaccttactctatgaaacgttgttatagcagctcaaactaagatagacagacagatagatacgtagatatatagagagatgatagcacatttttaactggaaacatcatcatctttttaactcaaaaaagtaaaagatgcattcttagtagaattattcttacacaggcaagacatctgcctctatcaattcaaatgtatagtctaacttcagcaagaatatctctgtaggggtaattgtaatatctggtaaatagtaagcataatttatagcttaagagagatttacactaatttatacttgaccagaaattaaaaaaatatgtcaatgaaaatattgttacaataaacaactcaggaaatgggaattgtaaagctcagagcatggctccctaagtttcatttaagtaagatcagaatttttggaatacttcattttaaatcatgcatattcagaacactggctaatggaataaagtttagtaatatatttaaatatgcagtctcaaaaatgttgtcactatgaaacatacaaaaacaaccaggagtatttaacttgaatacacagtctaagtagatgtacatatacataacccattacaaagtcctaaaaccgaaatcacttcattttatcagtagagtctgaaggccattcagtcatttgtttttcccctgggatattagcactattgcaaaacccaaaaagaatattttttccacaatctaatttttttgactaatctgtttgactttctgacattacatttgcattttttagtaacctctacagttataaaacattgctttttagatgaattcataataaaaattattttaataaaccttatgatatgtttttctcgcattttcattgttcgcatgcatagaaattgcttcctattccatcagatcttctcattttactggggtatttttaagtcagtttgagtagttgttcataaacttttatttttataaattgtgacactcttgtgggtaaaatttacactttaactaggaatgatggttcactatagaatgatgcttttctgacagttgttgatttgagagcatgtctctgttaactttaattccatctctttttttccctgtaatgctcaaaatgccaatacatcttcatttaccggttgaaaattcctcttcccaaggcaccaagggtctactaaagagtatgtcactaaaactgttgcatttttgcaagcttgggcatcacatatggctcacgctagactcagatagctgtgtggagcaaatgctcaaatctgtgccagaatttgttcattttaacatcactgggactttcaaagaacaaatgccatctatgtgaaaataacacactattaaaggatttaatagcgttactcataatggttaccttaatgataatgctgaattgatctattctgaaatttattccagattaaaacatcttgatagactgttgctgctactgctactgctgctgctgctgctgcatccctagatttttcttcatatggctataacttttgatatgccaataggaaccatatcagtgacagaagaataaggatgctcgtggaatcctcagggatagaagcagcagtgtgtagcagctggagtatgaaggcttatggcagaggcagcagtgagtggaggcagagacaaaaaggaaggatccagggtaatgcaggattagcaggagagatgacaatgttaagggacagtttaggggaaaaagtagaattttgttctaaataagctgcatattctgatttcagtgctcagtccattgtatttttttaagttttaaaaaaattccaagttatattttatttcctcattcataatacaataataagcatatattaatatttaatgtgtgtgttttttatgtgtatttcatgccctgggtctgttgtagatattggagatatagtgtaaattaacaaaatattttaagaatttcttcctaattgaaggtggcattctggtctatgaaatcatatactatagaacaagcatatatattgtcataattattaatacaatgaatgtaaaatgcttagtgaagtacataatgtaaatattaatctctaaataaatgtaacattgttatttttggaaaatgtgtatcactaatgccatatcaaagagctaaaaactcaaatacataaatcatcttctaaaacttgccaatgaatattttatacaatgtttataaattaatgttaatatttatgtataatgaaatgcaaagctcttaagtgtatattaagatgaattttgacacatgaatgcacagtacaagtaataaccaaatcagaatatagaacatttccatccccagagaatttcctcatgaccccttcctgtcaagctcttctctactcaagccctctatatttatatttctattcccataaataaatctagcttgttctgtaacttcatcacaatggcacaaatagtatgtatttgttttttttttttttttttttgatctggcttttgtttttttttggtctggcttttgtttttttttgagatagagtcttgatcattgttgattttattactgaatgtattattgcattgcattttatgaatatactataatttttaaatcaattattctattaatgaacacttggtagtttctagtctttgactcttacctataaagctttctaaatatccttgtacaagtagttttgtaaacatgtattttcactctttagtaaatacctagctgcattatggtgctttgtaggaaactaccagatacttttccaaaatggttgaaaatcttatacactaccagtatattaagagtttatgttgctgcacttcctccacaactttagttgtcatcagttgtttcaattttaggccttctagtagataaaaggccatagtcatagctcattgtagtttcaatatttgtttccttgatgactgatcaaataagcacctttttatgttcttacgggacatttgtgtagattttgctcatttttcaccaggtttgacttttttatgtattttgcatacaatttgtcagagagatggtgttacgggctgaactgtgtcccccaatatccatatgttgagacctaaaatccccaatgtgactgtatttagaaaggtgtataaggacgtaataaacgttaaatcaggtcatgaaagtcttaatctaataaaacttgtttcctcataaaaagaagacacaccagagatttctttctctttctgaacaggcacagaggagaggccatgtgaggacatggtgagaaggcagccgtctacaagccaggaagagaggcttaaccagaaaccaattgtggtggcactttgaagtttgacttctaacctccagaactacaagaaaataaatttctgttgtttgaaatacccaccctgtgatattttattatgaaagccctagtagactaatacagatttttagcaaatacttttcttttaggctgtggcttatgctttcaagggtgtgaagttatttcccctattttttcttctagaaactattattttaagcactctgcatgtatgcatgacccatgcgaaaatattttttatatgatgtgagattttgccattaaacgatcacagcaactttgttgaaagccacttagactgtgcatctactatagactactaagtgtagacttcctactctgatccattgttctacttgtttattattatgtcaataacaccatcttgattaatgaagctatattataagccttataatattttatttttatattttaaaattatatttacatatataaaacatttcatatttacataatataaaatatttacgttttatcatacttttatattaaatttaaaatttatattttatgtagttatatattaaatacataaatatataattcttattataagaaatcaggcaatgtatgtcctccaaatttatggttgcttttagtgttgttttgactattctaggtcctttgaatttccagaataattggttagtccatttgtaacaaattggttgttgggattttttattggggtttctttgaatctatagaataattggataacaaacattctaacaatatataatcttccaatccatgaaaactatttgtcttgccatagaccttctttaccatttctcccagaaatggttttaatgtttagtgcagatatattgcatgttgtccactaaattcattgctatgattttattgtttttatgccacagcaaatggtattgtgcttcaattaaaattttcacttgtttgttgctgttacatacaattgttcttttatatattgaccatgtatccagtgaatttgaaaaaaaagttattacatttataaaatatatttctcaggatttttcacgaatccaatcatttcatgtatgagtaaagagaggcttagtttcttttcagtcacgattttgctggatagcactggcaagacctctaatataatgttaaataaagcaatgagaactcacattcttgccttagttcaaatcttagtaagaaagcatcaatattctgccattacatatgatgttagttctaggtttttcagaaaaatacttcatcagatagaggaaattttcatttattctcattttactctgagctattaacatgactagatattaaagattgtttaatgatgtacccataatatttctcttttattagagtctcattttggattaattgctcttcaaaagttaaaccaatcctgcattcaatagataacgttccacatagtaatggattataatttatacttattattggacgcaatttgcaaatattttctttaaaatatttttatctttgtgtgtttcactgaatttctagatgtataggttgatatttttcaccagtttgacaagttttaagccattgttacttttaatatttttctctcttctcctagaaccacactcattgctatattacttgatattttcctatatattactagatcttcatttaattattttattattttggaagcttcactttagatcatgtctattgacctgtcattgatttcacttattcttttttctttactgtctaataagctgtttaacccattcagtgaattttctttcatttattgtacttttctagtatttccattttctttttatagatttcattcttttgcaatttcaaaattattctttcatatgtccaaatttttatttactttccttaaatatattttaacaactgtattaaatcctttttgttaactcaaaatcgatctcatctggtaatccatttttactgactgcttttgctgctaagtatatgtcacattttcctgtgtgtgtgtgtgtgtgtgtgtgtgtgtgtgtgtgtgtgtttttacatagctagtacattttttgaaattctgcacatggtcaatgttatcttaaaaggagagataatttctttctttatatggtactggtttgttctgataataaaaccctaacagatcttctgtattttgtttagctttagttatgatgtctttatttttgttaacttcttaattcaacggttatattctgattcaaaggtggtgtccttatccctataaaactttctgggttcttacgtaaatttccaagggtaggctagaactctaatggctccagtactgtatgacctcttatagtttccagtcggatctgagctgaacaggagctattgtctacaaggtaacaagcaaagtgctcagcatgaacatatgaagctcagttattaggtaagtactctcaaacatttccaggaagaattttggaatccttcttttgcagaattatgtatcttctctctctctgatcaaattctaggtgttttggtagctccaaactaatttttttctccatatcaatgtgcaccagacaatatgttaccagacaaaatgccagattgaatgtggagctcgtctgtatgtattttccttctttcaaggatatttcaagaaatatacatagccgggcgtggtggctcacgcttgtaatcccagcactttgggaggttgaggcgggcggatcacctgaggtcaggagtttgagaccagactgaccaacgtggtgaaaccccgtctctactaccaatacaaaattagctgggcgtggtggtgcaggcctgtaatcccagctactcaggaggctgaggcacgagaatcacttgaacccgggaggcagaggttgcagtgagcggagatcgcgccattgcactccagcctgggcaacgagagcgaaacttcgtctcaaaaaaaaaaaaaaagaaatatatatatatatatatgccttatagctaacttctagagtaaacaatgataaagaaattagaagcagaaagataaagataaatttacttcaaagagccaacagatggtagcaaacttcttcacaaaaatatattacaagaaacagagtcagataaagtgttcaggtaaccaaaaattgagaaattcttccacaaggagacctctcattctaaaaaactttgaagatgggatatttgatcacaagaaaaatttttcttgatgaaattgttgagatataagaaaaaaatggaaaagaacaacaaaaggttatagtatgtgagtgaatttaaataaatattgatgatataaaataattctcgttgtatattttggagttcaagagttcaagagaaagaataaaagcaaagtagaattaagataaaaataactgctgcaaagaagcttatagagataaatgatgttaaaatgttcaaagatcttagatcatgtaagaggaggaaaaacattgatagacatattataaaattaagcaaatatatttcaatgactagagtagcatcaaaaccattggaaacagcatacaactttcaaatagataggagtttcctgtggactattttggctgtaatttctgctattttctgttcaaagtatcttattttctatattctgagttactttaaccttaggctgatcattttccttatgattttatttgtataaacatttaagacccaggatgatggtgggtccctacaggaaagatgtgtaaatgtttctaccatttgctttggaattgcaagatatgtcaacatatgtaaagtgtcaacaaaataaataaatgccatatgtgaaaacttttaagtaaaaacattattgaaaacccaaaaacatacagatacacagtttttcaaagaaaacaatgataattcagagcacagactttttaaaaatagttgttacatttgtaaagtaagttatatgttaagaatcacatacaatataaaataattgaaaaaaattgcataatggcacagagaaaaatgttgatccttgtacatattatcagtacagtaactctattctacatgtatataaaaataaaaatgtaaaaatttggattctagatatttactggagcaaaaatattaatgctcagagcagaaagttagaaaactcagcagttttataactcatgaaacatttttaatgaaacagaaatgtaacattatgaaatcttgagatagtagaaatgaagtatgattaaactattttaaatttaaccaatattcatattcatatatgcattgaaaaattatacctttttctaagtttgattcttgaaaattatagttagttttaaattatttattttttcagtgattttgtcacatttaaaattcccccttgaaaaattgctttattaaagtgaaatatttgaatatggagtttgaagagtaacaaataatttttcttataatcagttgtaaaacatatataattttcaacattagtttagtatctacatgtattttaatcctataaaagcaatatttttattgtaaccagaaattagatattcataatgctaacagatttttaaatattatagctattagtatatataacttaaatatttctaatgtttgaaatttcctataaaactggttcttaaacccttcaactactagaagcctttaatgcagattgataaatgtgtactttacctaatttataataaatatggcatattaagtacattttctttcttgactctatatttccagaattttaattcagacttccataagaatcaggaaattatttactttgacctaaattaatttgaaactccctacaatggtactttgtgaacttcgtgtttttagttatttcagtttctgacatttgtgtatcaatatttttaaagttagtccattttcttacatgtgttctattcagcatgcttccaccaaaaaaaaaaaaaaattaagcaattatggctttcttccatttagattatgtgggcaggtctgtgggggtagtacagaaggtatatttcatctcaaacataaacaggaagccaatgtgctatggaatgaatgtttgacccctgtgaaactcatgttgaaacttaatccccaatgtggcagtattgagagatgggatctgaattaattaatgtaaattccagtagactcaacacactggcatcaaccattataattacaacaatttttatgaaacacttatattttcaatacctgttatcctttttgaaataataaggacagagaatgtaaaaggaagtggaaaagcacagtgtggttaagagattcataaaattgtgcttggattataaaacactttaaaataccttgagacatttttgaaccaaagtttgtcagaaatatctatacacatgtaattaatgacaactataagtaagctaagacaggctgggctgagaaggtggtattaggttttgggggcagaagtctttgcagaatgtaaagtataataggatagacggtatttcagtggaaacctactgattttttttgttttcctgtattcctttcacttttctgtctgtcactcttatttctttcaatcctctttgagcttttttgctcttttccttttatttctccactcttgctctctcaccctctctctcacacactcttcttcccacaattccttcgtccctctttctcctttaccacatccctttcagaaacctttattgaagatatattatgtgaaaggtatgaggtattcaca

SEQ ID NO: 1659 - DNA, 1397 bp, Homo sapiens
tgctgagaatgtgtattcttgcaacatctctgaaaatgttgcgatttttttctctctctttttttaagtactactttattgagttacatgggacatacaataaaatatcctattataactatacaattgaaacattttggtaattttgtatagccatgtaatcaccataacaatcaagatgtaaaacctttcattcaccttaaaaagttcatttgtgcccctttatggtcattcacatccccttttctgagtatagttttacaatatattctttcagaaagcttgcaattttccattcttgaatatgtctttgaaagatcaaaagttgtaattttgatgaagtgaagtttatccaactttttatttattgttactgtttatatcacattattaaaaaaaaccttgcctagccctctaaaattgttcaaattttatttgataaaagtatttgataaaattcaaatacttagtatagaaaaaataaacttttagattttgtttcaattttattttttagccccatgtctttctctctctgacatatagacaactcctatttttatcaaactaaacatattatacaaacaataaatcaaaataataaaatagtgataattttaaaacttagactattaaagaaatatattttatttagttatgtgatttcatgatagaaagcattgtataaatgatgcaagaaaccccacaaaccatagcaatcatttaaaaaaaaaacgtgctttaaaatcttctacaggaagaaattaaaaacaaatgtagagatagggaaaaatattttaacataaaattttagtttcagaaaatacaaagcattctgacatttgacttacaaaaagacaactcaaatagagaaatagaggaaataataaaaataggcaactagttcatcaaagaaaaagggattgaattataagtaaaacataaagtgttcttagctttctgataactagggaaatttaaacagaaatagtaataagatatgtttgaataaccatcagatgataatcgacaatgagaaagaatgaagttgggaatataatgtatttctaataaaaccgaaaataaacacatctaaaaatctagtgattctacttctaagaatatgcagaatatgcacatcttatgatctagcaattccacttctaagaatatacactaaagttactcttaaccactgctcactctaaacattagaaatacccaaatatctttataaactatttatttgcatatcaataggtatagaacgcagaaatattctcttgagaggataaataggcagcagaccacacacaacatttaaacagtatatagtaaaattatggaaattacttttgaaggcccccgtcatctgcatacgaatgcttattcgagga

SEQ ID NO: 1660 - DNA, 6310 bp, Homo sapiens
tgagacacattactaaataaatggtaatagaattattccctaaaacattggaaattgttctgttccaaggtggcagaataggaatagctctagtctgcagctcccagtgtgattgacacagaagacaggtgatttctgcatttccaactgaggtacctggttcaactcattaggactggttggacagtgggtgcaacccacagagggtgagccaaagcagggtgggtcatcacctcacctgggaagtgcaaggggttgggggatttccctttcctagccaagggaagccgtgacaggctgtaccaggaatatcgggacactgccacctaaatactgcacttttccaatggtcttagcaaatgggacagcaggagattatatcccatgcatggctcagctggtcccatgcccacagagccttgctcacttgctagctcagcagtccaagatcgaactgccaagcagcaagcctggctggggaggggcatccaccattgctgaggcttgagtaggcaaacaaggtgaccaggaatcttgaactcggtggagcccaccacagctcagcgaggctcacctgcctctgtagactccacctctgggggcagggcatagctgaacaaaggcagtagaaacttctgcagacttaaacatccctctctgacagctctgaagagagcagtggttcttgcagcatggtgtttgagctctgagaatggatagactgcctcctcaagtgggaccctgaccccgtgtagcctaacttggagacacctccaagtaagggctgactgacacttcatacagctggtgcccctctgagatgaagcatccagaggaaggatcaggcagcaatatttgctgttctgcaatatttgctgttctgcagcctctgctggtgatacccaggcaaacagcatctggagtggagctccagcaaactccaacagacttgcagctgagggacctgactgttaggaggaaaactatcaaacagaaaggaataccactaacatcaacaaaaaggacattcacaccaaaaccccatctgtaggtcatgatcatcaaagaccaaaggtagataaaaccacacagatggggagaaacaagagcagaaaagctgaaaattctaaaaaccagagtgcgccttctcctccaaaggattgcagctccttgccagcaatggaacaaagctggatggagaatgactttgaggagttgacagaagtaggcttcagaaagtcagtaataacaaacttccctgagctaaaggaggatgttcaaacccatcacaaggaagctaaaaaccttgaaaaaagattagatgtatggcaaactagaataaacagtgtagagaagacgttaaatgacatgatggagctgaaaaccatggcaggagaactatgtgacacatgcacaagcttcagtagctgattcgatcaagtggaagaaagggtatcagtgattgaagatcaaatgaatgaaatgaagctagaagagaagtttagaggaaaaaagagtaaaaagaaacaaacaaagcctccaagaaatatgggactatgtgaaaagaccgaatctacatttgattggtgtacctgaaagtgacggggagaatggaactaagctggaaaacactcttcagtatattatccgggagaacttccccaacctagcaagtcaggccacattcaaattcaggaaatacagagaacaccacaaagatactcctcgagaagagcaaccccaagacacataattgtcagattaaccaaggttgaaatgaaggaaaaaatgttaagggtagtcagagagaaaggtcgggttacacacaaagggaagcccatcagactaatagcagatctgtcggcagaaactctacaggtcagaagagagtgagagccaatattcaacattcctaaagaaaataattttcaacccagaatttcatatacacccaaactaagcttcataagtgaaggagaaataaaatcctttacagacaagcaaatgctgagaggttttgtcaccaccaggcccgccttacaagagctactgaaggaagcactaaacacggaaaggaaaaaccagtgcaagccactgcaaaaacatgccaaattgtaaacaccattgacgctaggaagaaactgcatcaactaaagggcaaaataaccagctaacatcataatgacaggaacaaattcacacataacatattaaccttaaatgtaaatggactaaattccccaattaaaagacacagactggcaaactggataaagagtgaagacccatcagcgctattagtgcgctgtattcaggagacccatttcatatgcagagacacacataggctcaaaataaagggatggaggaagatctaccaagcaaatggaaagaaaaaaaaaccaggggttgcaatcctagtctctgattaaacagacattaaaaaaacaaaggtcaaaagagacaaagaagggcattacataatggtaaaggatcaattcaacaagaagagctaactgtcttaaatatacatgtgcccaatacaggagcacccagattcataaagcagtccttagagacctgcaaagagacttagactcccacaaaatagtatagggagaatttaacaccccactgtaaatatcagacagatcaatgagacagaaggttaacaaggatatccaggacttgaactcaggtctgcaacaagcagacctaatagacatctacagaactgtccaccccaaatcaagagagtatacattcttctcagcaccacattgcacttattccaaaattgaccacatagttggaagtaaagctctcctcagaaaatgaaaaagaacagaaatcacaacaaactgtctctcagaccacagtgcaatcaacttacaactcaggattaaggaactcactcaaaaccgcccaactacatggaaactgaacaacctgctcctgaaggactactgggtacataacgaaatgaaggcagaaataaagatgttctttgaaaccaatgagaacaaagacacaacataccagaatccctgggacacatttaaagcagtgtgtagagggaaatttacaacactaaatgcccacaagagaaagcaagaaagatctaaaatcgacaccctaacatcacaattaaaagaactagagaagcaagagcaaacacattcaaaagctagcagaaggcaagaaataattaagatcagagcagaactgaagcagacagaggcacaaaaaaccattcaaaaatcaatgaatccaggagccggttttttgaaaagatcaacaaaattgatagaccactagcaaaactaataaagaagaaaagagagaagaatcaaatagatacaataaaaaatgataaaagggatatcaccaccaatcccacagaaatacaaacttccatcagagaatactataaacacctctacgcaaatagactagaaaatctagaagaaatggataaattcctcgacacatacaccctcccaagactaaaccaggaagaagttgaccccctgaataggccaataacaggctctgaaattgaggcaataattagtagcctaccaaccaaaaaaagtccaggaccagacagattcacagccggattctaccagaggtaaaaagaggagctggtaccattccttctgaaactatcccaatcaacagaaaaagagggaatcctccctaactcatttgatgaggccagtatcactgtgataccaaagcctggcagagacacacaaaaaaagagaattttagaccaatattcctgatgaacatcgatgcaaaaatcctcaataaaatactcgcaaactgaatccagcagcatatcaaaaagcttatccaccaagatcaagttggtttcatccctgggatgcaaggctggttcaacatatgcaaatcaataaaagtaaaccatcacataaacagaaccaatgataaaaactacatgattatctcaatagatgcagaggaggcctttgacaaaattcaacaacacttcatgctaaaaactctcaataaactaggtattgatggattgtatctcaaaataataagaactgcttatgacaagcccacagccagtatcatactgaatgggcaaaaaaatggaagcattccctttgaaaactggcacaagacagggatgccgtctttcaccattcctattcaacatagtgttggaagttcaggccggggcaatcaggcaagagaaagaaataaagcgtattcaattaggaaaagaggaagtcaaattgtccctgtttgcagaagacatgatggtatatttagaaaaccccatcgtctcagcccaaaatctccttaagctgataagcaactttagcaaagtctcaggatacaaaatcaatgtgcaaaaatcacaagcattcttatacaccaacaacagacaaacagagagccaaatcatgaatgaactcccattcacaattgctacaaagagaataaaatacctaggaatccaacttacaaaggatgtgaaggacctcttcaaggagaactacaaaccactgctcaatgaaataaaggaggacacaaacaaatggaaaaacattccatgctcatggataggaagaatcaaaatcgtgaatatggccatactgtccaaggtaatttctaggttcaatgccatccccatgaagctaccaatggctttcttcacagaattagaaaaaactactttgaagttcatatggaaccaaaaaagagcccgcattgccaagtcaatcctaagccaaaagagcaaagctggaggcatcatgctacctgacttcaaactatactacaaggctacagtaaccaaaacagaatggtactggtaccaaaacagacatatagaccaatggaacagaacagagccctcagaaataacaccacacttctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaactataaaaaccctagaagaaaacttaggcaataccattcaggacataggcatgggcaaggacttcatgtctaaaacaccaaaagcaatggcaacaaaagctaaaattgacaaatgggatctaattaaactaaagagcttctgcacagcaacagaatcgaccatcagagtgaacaggcaacctacagaatgggagaaaatttttgcaatctacccatctgacaaagggctagtgtccagaatctacaaagaacttaaacaaatttataagaaaaaatcaaacaaccccatcaaaaagtgggcaaaggatatgaacagatacttctcaaaagaagacatttatgcagccagcagacacatgaaaaaatgctcatcatcactggtcatcagagaaatggaaatcaaaatcacaatgagatagcatctcataccagttagaatggggatcattaaaaagtcaggaaacaacaggtgctggataggatgtagagaaataggaatgcttttacactgttggggggactgtaaactagttcaaccattgtggaagacagtgtggcgattcctcaaggatcgagaactagaaataccatttgaaccagccatcccattactgggtatatacccaaagtattataaatcatgctactataaagagtcatgcacacatatatttgttgtggcactattcacaatagcaaagacttggaaccagcccaaatgtccatcaatgatagactggattaagaaaatgggcacatatatacactatggaatactatgcagccataaaaaaggatgagttcatgccctttgtagggacatggatgaagctggaaaccatcattctgagcaaactatcgcaaggacagaaaaccaaacactgcagtttctcgctcataggtgggaactgaacaatgagaacagttggacacagggtgtggaacatcacacactggggcctgttgtggggtggggggatgggggagggataacattaggagaaatacctaatgtaaatgatgagttaatgggtgcagcaaaccaacatggcacatgtatacatgtgtaacaaacctgcatgttgtgcaaatgtacactagaatttaaagtataataaaaaaattggaaatttgtgtgggagaaataactattgggatttaatgtcaaaggtacaatatttacacataaaaagttttattatgggta

SEQ ID NO: 1661 - DNA, 6312 bp, Homo sapiens
aactgcagaattcctgacacataatagttgttctataattggtagttaaaattacacttatagatcatttcacctaggatttagctaagctctctatacctagaatacagttaagaatgacattattagagggcagccaagacggccgaataggaacagctcctgtctacagctcccagcatgagcaacgcagaagacgggtgatttctgcatttccatctgaggtaccgggttcatatcactagggagtgccagacagttggtgcggggcagtgggtgggtgcaccgtgcatgagccgaagcagggtgaggcattgcctcactccagaagcgcaaggggtcagggagttccctttcctagtcaaagaaaggggtgacagatggcacctggaaaatcaggtcattcccacccgaatactgtgcttttctgagaggcttaaaaaacggtgcaccaggagattatatcccgcacctggcttggagggtcctatgcccacggagtctcgctgattgctagcacagcagtctgagatcaaactgcaaggcggcagcgaggctgggggaggggtgcccgccattgcccaggcttgattaggtaaacaaagcagctgggaagctcgaactgggtggagcccaccacagctcaaggaggcctgccggcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccctgagcagcctaactgggaggcaccccccagtaggggcagactgacacctcacacggccgggtactcctctgagacaaaacttccagaggaacaatcagacagcagcattcgcagttcaggaaaatccgctgttctgcagccaccactgctgatacccaggcaaacagggtctggagtggacctctagcaaactccaacagacatgcagctgacggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctactccaaaggaacgcagttcctcaccagcaatggaacaaagctggacggagaatgactttgacaagttgagagaagaaggcttcagatgatcaaactactctgagctacaggaagaaattcaaaccaaaggcaaagaagttaaaaactttaaaaaaaaattagacgaatgtataactagaataaccaatacagagaagtgcttaaaggagctgatggagctgaaagccaaggctcgagaactacgtgaagaatgcagaagcctcaggagctaatgcaatcaactggaagaaagggtaccagtgatgtaagatcaaatgaatgaaatgaagcaagaagggaagtgtagagaaaaaagaataaaaagaaatgaacaaagcctccaagaaatatgggactatgtgaaaagaccaaatctacgtctgatttgtgtacctgaaagtgacgggtagaatggaaccaagttggaaaacactctgcaggatattatccaggagaaattccccaatccagcaaggcaggccaacattcagaatcaggaaatatagagaacgccacaaagataccccttgagaagagcaactccaagacacataattgtcagattcaccaaagttgaaatgaaggaaaaaatgtaaagggcagccagagagaaaggtcgggttacccacaaagagaagcccatcagactaacagcggatctctcggcagaaactctacaagccagaagagagtgggggccaatattcaacattcttaaagaaaagaatattcaacccagaatttcatatccagccaaactaagcttcataagtgaaggagaaataaaatactttacagacaagcaaatgctgagagatttttgtcaccaccaggcctgccctaaaagagctcctgaaggaagcaataaacatggaaaggaacaactggtaccagctgctgcaaaatcatgccaaaatgtaaagaccatcaagactaggaagaaactgcatcaactaatgagtaaaataaccagctaacatcataatgacaggatcaaattcacacataacaatattaaccttaaatgtaaatggactaaatgctccaattaaaagacacagactggcaaattggataaagagtcaaaacccatcagtgtgctgtattcaggaaacccatctcacgtgcagagacacacataggctcaaaataaaaggatggaggaagatcaaccaagcaaatggaaaacaaaaaaaggcaggggttgcaatcctagtctctgataaaacagactttaaaccaacaaagatcaaaagagacaaagaaggccattacataatggtaaagggatcaattcaataagaagagctaactatcctaaatatatatgcacccaatacaggagcacccagattcataaagcaagtcctgagtgacttacaaagagacttagactcccatacattaataatgggagactttaacaccccactgtcaacattagaaagatcaacgagacagaaagttaacaaggatacccgggaattgaactcagctctgcaccaagcagacctaatagacatctacagaactctccaccccaaataaacagaatatacatttttttcagcaccacaccacacctattccacaattgaccacatagttggaagtaaagctctcctcagcaaatgtaaaagaacagaaattataacaaactatctctcagaccacagtgcaatcaaactagaactcaagattaagaaactcactcaaaaccgctcaactacatggaaactgaacaacctgctcctgaatgactactgggtacataacaaaatgaaggcagaaataaagatgttctttgaaaccaacgagaacaaagacacaacataccagaatccctgggacacattcaaagcagtgtgtagagggaaatttatagcactaaatgcccacaagagaaagcaggaaagatagaaaattgacaccctaacatcacaattaaaagaactagaaaagcaagagcaaacacattcaaaaggtagcagaaggcaagaaataactaaaatcagagcagaagtgaaggaaataaagacacaaaaaacccttcaaaaaattaatgaatccagaagctggttttttgaaaagatcaacaaaattgatggactgctagcaagattaataaagaaaaaaagaagaatcaaatagacacaataaaaaatgataaaggggttatcaccactgatcccacagaaatacaaactaccatcagagaatactacaaacacctctacacaaataaactagaaaatctagaagaaatggataaattcctcgacacataaaccctcccaagactaaaccaggaagaagttgaatctctgaatagaccaaaacaggctctgaaattgtggcaataatcaatagcttaccaaccaaaaagagtccaggaccagatggattcacagctgaattctaccagagaggtacaaggaggaactggcaccattccttctgaaactattccaatcaatagaaaaagagggaatcctccctaactcattttatgaggccagcatcatcctgataccaaagctgggcagagacacaaccaaaaaagagaatttgagaccaatatccttgatgaacactgatgcaaaaatcctctataaaatactggcaaaccgaatccagcagcacatcaaaaagcttatctaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattcaacaacccttcatgctaaaaactctcagtaaattaagtattgatgggacgtatctcaaaataataagagctatctatgacaaacccacagccaatatcatattgaatgggcaaaaactggaagcattccctttgaaaactggcacaagacagggatgccctctctcaccactcctattcaacatagtgttggaagttctggctagggcaattaggcaggagaaggaaataaagagtattcaattaggaaaagaggaagtcaaattatccctgtttgcagatgacatgattgtatatctagaaaaccccattgtctcagcccaaaatctccttaagctgataagcaacttcagcaaagtctcaggatacaaaatcaatgtacaaaaatcacaagaattcttatacaccaatagcagacaaacagagagctaaatcatgagtgaattcccattcacaattgcttcacagagaataaaatacttaggaatccaacttacgagggatgtgaaggacctcttcaaggagaacaacaaaccactgctcaatgaaataaaagaggatacaaacaaatggaagaacattccatgctcatgggtaggaagaatcaatatcgtgaaaatggccatactacccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaatagagccctcagaaataacgccgcatatctacaactatctgatctttgacaaacctgagaaaaacgagcaatggggaaaggattccctatttaatcaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccatgcaggacataggcatgggcaaggacttcatgtctaaaacaccaaaagcaatggcaacaaaagacaaaattgacaaatgggatctaattaaacgaaagagcttctgcacagcaaaagaaactaccatcagagtgaacaggcaacctacaaaatgggagaacatttctgcaacctacctatctgacaaagggctaatatccagaatctacaaagaactcaaacaaatttacaagagaaaaacaaaaaaccccataaaaaattggccaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtctggaaacaggtgctggagaggatgtggagacataggaacacttttacactgttggtgggattgtaaactagttcaaccattgtggaagtcagtgtggcgattcctcagggatctagaactagaaataccatttgacccagccatcccgttattgggtatatacccaaaggattataaatcatgctgctataaagacatatgcacacgtatgtttattgcagcactattcacaatagcaaagacttggaaccaacccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgagaactgaacagtgagaacacatggacacaggaaggggaacatcacactctggggactgttgtggtgtggagtgggggagggatagcattaggagatatacctaatgctaaatgacaagttaatgggtgcagcacaccagcatggcacacgtatacatatgtaactaacctgcatattgtgcacatgtaccctaaaactgaaagtataataataataaaataaaaaaagaatgacattattagctttattccattaa

SEQ ID NO: 1662 - DNA, 7946 bp, Homo sapiens
attcttaattgagagcagtcatatcacaaatacacaaacatcttttcaggtgaaccctccactggtattgacaatggagaaagctctgagaaattcacctttagatttgagttaatttgagttgtggtaaatcttagtaacaacaacaaacagtagcactaaaatgtatgtagatgcattaggctaagtattttatgtgtatcactctatttaatctttacaacaacccatgagcaatactattattattgatacagcactttatagaccagggaactgaagtacagagggctaaacttgtttaatgaagcgctcacagggtcgagaccggctccagttcactgttgagcactgtgcaggcctgcctgtcagcacagggagagcaacagttgaatttagcatccttcttatctgggggggtcatgagtaggaacgtattcattatattctgaggacttaagtggttgactgaaaacccagagcatttcaggtattacatctagagtttttaacgttacatttagatattacatttagggtttccataatatttgagaataatctagaactgatcatagaataaagtgaaaggaatgcaaatttctagctgattccctacccatttgttgaataaattcgggcaatcaaacaatctgaaatgtagcataatattatggctttggtttttaagatggaaaaagtgatttataaatgaacagattaagaatcagttttttacttttcctgatgggcttttgtggacactgttgtagttctcaataatcttgaatttatgaatgtgccggctaggaaattatcaacaccacatgctgtttcccacactgaaaacttttaagtattgagaaaaaaaatctgtatttatatgggtgataaagtgaaaaatataaaataaaattttcagagttgtgagggatttgtttatgtgctatagaagtatattggagaagttttaaaaactggttggttaaaaaaaatcagttagcttgaattttgagtggggtgtttcagttctagctagtggattgcttaatcatcaacattcagcttctgagaagaaatttcttcccaagtgaatacagtagactcttggctttcccagatttaacattttcagtttctattatttgggaatgaactttaagctcttcaatgtggtgatttgtaattgggtcaaatcataaatatgacagtgagaatgcaagactaatttgttggagccactcctagccaaggagaaagcctgtacccacatcttctcaagtgtgtatcttatggaggaaatcatatgttgtagtggtatttacaaaagcctgaggacatccatcataaatgttaatggtctgctagttgtacttaaactacaacttttctccatgcactcactaacactccctccctccctccctccctcagacctcctctacaccagagcctcctgccaaaccttcccacacctttgtcattaaccctttttatttcaatctctcttttagctggagacctgatttttctactcagttttaaatgctcttaagtatcatattttgtcactctatttgtagcacatctgtcctttcttctggatcttaaatacattctgaatgaaattcagtcttgttttgaaggtcagctttccttctattcaaaccatgtttgtcagttatggcttttggtttgtctttgagggggtcttgttttccctctcatctttatgaatccttacttgctgctctgcaacatgtgtaaatttcttgttcacagcatgtcagcaaataacttgtcaagcttcagtggctcactgtgatttttttctacctccaaagagtatatgagtagattcaataacatgctgtagagccccaaaccaaccctgtgggagaggtcagagttaccctcagattttgtagtagagactcaggaataagtagtgacacatagacagaaaacatcagaatgtgacaagcaatggctgaacccacttgtggattttgcactgccattttacctctttaggcaaaataagaggtttctgtttctgagcctagtctattcccttagaacctttccatgttatcctttatctttatgcaatgtttcccatatgtcagccattcatggccattcaccatcccattttttgttatgagctttcaaactcaaattataatttacgtgatatttaaaaaatttgtctctttaactttgtattcatttgatgttgccttttctaaccgtgaccataaataaaaacccactatcacatggcacaaacataaataagatcaaaagtagtatttttatcatttgtctactattggcctgcgcatttgctgaaactgcagcctattgtttctttcttgaaactggggagtaggaagccttctggttatcagttgctgcaaaacaagccacccaaaacttagtggtttaaaataatactttattactatcactcacatttttgtgggttgacttggctatcctgtggtactcgtttgggtttggcatgaggtttcatttgacagctggggcagggattatctgaaggcttgattgggctggatgttcatggtggttgtcttatttggctgggcaagggctgctacctgttagctgggaccgcctgaagctatttcctgtagtgcctacacgttgcttcttcatatggtttgtcatcacatgtggcagctaagttccaagagtgagtgctcaaagaagtcttcgtggacactgaggtttcttaggatctaggctctgaagtcccacaacatcttaaccactttctattgatttagtctagttcagattcaaggaaaatagtagggaagaatttgtggccatctttttatctatcacagttattgtcagaggggtgttaaagaatagcaaacttaaatgttctttgtgatgtaatcagagggattgaaagagaactgaaaggggaatggcattctaccatgtcatttaatgttatttaattctgtctccattcattgctttaactcatcttggcaccaccaatgtcagtgagcccctcctcaatgtattcaccctcttctgtgatgcttcatatctctttcctttgggatttcaagaagaatttggttgatatgttcttctatcattttgagggttaccttctgtcttttcctaatgctaaaaatacaaagaagaaaggtagaaaagcaaaagtagcattgtaatgaacaaaattagtgttttcaaggcaaacagccaagtattacataagccaactcacagggcatttttacaaaaattctggagaaatggctatgctggtttccagatttagaaacctctctggctcacttgaaaggactacttgggaggagggatcctatcactagacaccttccttcatgggtcaaacttttgattcaagtgtgcatgggtgagatactaagatgaaataatttgagtgtcaaaatctatgtttattatggaaaattttaaggttatattgtttctcaggaataacccaaacagacactgatgactagcattagtgacgttatggccagattatgtgaaaattgacaagcaaatatggtgtagttttcccctcttttaggaaaagcacaaagaaggatccattttgtgaaaaatgcacaaactcttaaggttaaatttagaaccaagggtcatttttaaatgaagtttgatggtatgatttttttgactggtatattgctttatatctgcatctagtcattatatgcatatatttcaaccaaaggtatacagttttagaaacttcctttcatcaagtttcaatttttccttttgcatttattgctcaatacatgattagtcatgagtaagcatccagaatgatatatgtattagctcttcactttggacaagaaatttcttccaatttatataatcactcaacatgacttaattgtcatggttaaatctccttgactctgtactcagtggcattaagcaagcaaatgttgcttatttttcactaagtactaactatgaagagctgttaggagcctctaggaagttaacttacatgaaaattctctcttgaccccattatatttttaaagaagtatagatactagccaatgctgggactatgtcttagataaatattcaagatgctctgagtggaatctgtgctaacattattaccactggtatagtttttgctctgaagatttatgaaatggattattattttgaaagtgttaagcactgttaggggactctcttttttttgacttggactggatcccacaattctaaaagtatttatgaaaacaatatgatgaaatgttaatgatggaagtgtatccttgaactttgattttaaaaaggtgttaaatcactgatgagtccttgtcttcacctttgcttagttccaagattaaactcagtcataaacatgatatttataaagagtttctcataacttagatattacaatagtaaatgaagcaacagaatcgattcacaattatgtatacaactcagtacaacaattcaaaaataaatatgcctagaaaaatacctggaaaaatataccaccatgtcaatagtcattgccttctgtttggattatattgtttcccctttggtaatctttttctttacacttttctttaattttttcaacttttctataatgaaaacattttagcattggcatgtgtcacttaactaaatgagattctgtgattgctaatgtatatgcttcagtgaattgttagtttttaaattatgttaatgaataaacagtttccaggccagtcattttctagcctcattaatgccatagtgacatttgttatactgtactgaacgattttatataagagacttgagcattcttgaatttggtatccttctggggtcctggaaccaatcccccatggatatggagggccgactgtaaacgccttctcctgatttgggttttatacatttgtatcagcagtcttataaacaccctagaaggaagctccaccttccagaagatgaggcagcatgctccttaactgttgaatgaagattctttcctgtttccactctttgtttggtgggcaggaaggctcctgctcttcagttggaagtggctgcagctgttattagcagataagcaggagtggcctggccatttctgtgactcacagtgacttagtgggattcatatcaagaattccttccttttctcttgacagttttcaggtacttcagaaggttaggtagaagggatatgagtgattaagatatattttataggaataattgaaagctgggcatttgatgtgttttgattttagaacagagtactggacagcttcacatttggattctgggcaggtatgaattctaatgagagagttaaaaatagtgctaggtaactagtaaagtaagtgacacagagactttcctttagttcttcgtccatctttgtttctcattcgttgacttgcattgcctcatcctttatctactctatcagtgtgaggttatagaataatagagagaaaaagaaaacaaaaataacatacttaatttcaatttatttattgaatcaaacattacctaaagttgttcttttgacattttttctcctgtgatacacagatgtctcactgagtatcaaatagtgagagggaaaaagattcccatggggtgaatctgcatggaagagtgtgcattaatctgtgcaaatgcctactaatcttggaacttctgaagtaaagaaaaatccattactactgctctatataaatattaacaacctaaaagtaacttaagtgatctgcaatggaatatgtgccatttagatcttttaactacttcacactttcataagacttaccacatatcccaacctcccactttaaatagacgtttttgaaaatatcagtcaaggagaatctttaattactacattgcttcagggaaacatacaattttggtaataagaaacactacttcaacagatctgttcttcacaaaatagagtacatgcaaatgatatgactgaactcaaattcagatgtttggcagttgagctatttggtgaaatgtcttgagggaaagatctttgggttcttttatacttgatgactttaaatctgtgaaaactaaggggctaaaataaaatgaaataactgggtcttttgtttttcttcttaatagtttattgtgtaaagaggcctcgttttcctactataccttattctttgatgcttttcatttccttgtatgttttggaaaaataatgtatgttcatagaactctaggcaccatacagcgacaattggtcaggccttctgagctgcaacacactgcagatgtgaggaagaattgtaatcagtaggtcatctgcctgcataattttcagggagccatcttgctcctaccaggacacatatggaggggcatgtttgcaattttattaataacatttttaactcacaaaagttcccacataaggaggccagcactgtcaaagttcttttttctatctgggaagggcttatttggtttattgtgccttctatgatcttgttttctataaagataggctgctaaaagtggtagacagttactctttactctatgccctattctacatcagtgctgaatgagcaggggctgtggacagaaggtcatgagggaggggtcagttggagggtggcagggcaggtaagtgaagggtttgggctaagtcacattatatgctcaccctcttaagtttcgtgtggtaaattccagctggaataaaaataagagccaccttgattgggaaaagaaactgggaggtgtctcggaagggaagatagagcctaagaagcagtatctattgctagcaagaaagcctgggctccctttgcccccataaaagtgtttagatctggtcggtgaaagtcagacttaaactttcctcacccacctcagagcagcattctggaatagttgctatcatttatagtgctctgaggatatttcaggttttgtttttttctttaaaggataaagtcattgatagaactataattacaaggaggctcagctgttgctgtaggtggtaacaacttataaggcagtctacaccggctgatcttcaattaaattattcatttctgcatgcaaattccacccattcttttcctttttatggcagaagctaccagtacctttatacaaatgatcttggtggggttcctgtcttcctgtttggagatggccttattgagtatgattcaagaaatagacagacctcttgccttcctcataccaacctacaaccatccaaccaaccaaccaaccaaccaaccaaccacccacccacccacccacccacccaaccatccaatcacccaaccaaccaatgatctaaccttttcataggacagaggcctttattcccagttttaaattcagtgggaagcataaaggactatgataaaattatttcttgaatgtcttattactacacaggtcagttgaacatgaaaggggaagtggagaggtttaaattgttaaggttaaaattgtcaaaattggagggctgtggtcattttacataatttacatatgtatattcaattttgtttaaggctagattgtaaaatatcctgcatagagcagaactggactattttaaaggaaattcttttgaatgggtaatgagcaagacatgatgtgaccaaaggacctgaaaaactgccaatttctcagttttaggcttctgtgatcttccccatactttctctgttgggtcattgctactcatattgattgcacggtcctctgatactcactcattccacagttaccatctgatgagatgtggctagtttcagtgctctgattctgttgaatgagattatgcagtgaacttgggtattttcttcagcttgtgatggtttagg

SEQ ID NO: 1663 - DNA, 8123 bp, Homo sapiens
aggacatcttcagatcaatccttttcagagtctattacgaactcacagtatcttactcgtagaagaaatctggccataggtatttgtctgacttggcctaacctataattcactcaaagttcagtttagtttagtttttttttgtttgttttttgttttttgtttttttttgagacggagtttcactcttgttgcccaggctggagtgcaatggcgcaatcttggctcactgcaacttctgcctcccaggttaaagcgattctcctgcctcagcctcccaagtagctgggattacaggcatgtgccaccacgccaggctaattttgtatttttagtagagacagagtttctccatgttggtcaggctggtctcgaactcctgacctcaggtgatctgcccacctccgcctcccaaagcgctgggattacaggcgtgagccaccacgcccagcttagttttgatttttgttttttggtttttttggagacagagtcttgctctgtcactcaggctggagtgcagtggcaggatctcagctcattgcaacctctgcctcccaggttcaagtgattcttctgcctcagcctcccaagtagctgggattacaggtgctctccaccatacctggctaatttttttatgtatttttagtagagacggggattcaccatgttggccagtctggtctcgaactcctgaccttaggtgatccacctgcctccaccttccaaagtgctgggattacgggcatgagccaccgcacctggcccagtttagtgttttttttgttttgttttgtttttgagatggagtttcgctcttgttgcccaggctggagtgcaatggcacgattttggctcaccgcaacctccgcctcccaggttacagcgattctcctgcctcagtttcccaagtagctgggattacaggcatgcgccaccatgcccagctaatttttgcatttttagtagagatggggtttctccatgttggtcaggctggtctcgaactcctgacctcaggtgatctgcccaccttggcttcccaaagtgccagtttagttttttaaaaggctttaccaatcatggagaaaataaaattagagggataattttggtgaccctttgctttctgtttcttctcaaacttctcaccttttttcttcttaatcattagaaactgggaataaataagactgatccgagcacactgacagaagaggaagtgagtaaatttgcccgtctcgacatcgacccatctaccatcacgtggcagagaggtgggtgctggggagatgccagcaggctgatggccaggtggggaggcgtgttcgagccgaagcgcttaaattcagaaacttacagtttgatcctgtccagtgatcttcccagcctgtgcttcatattcccaccatttatttcagttactattatcgtaccaccctcccttatccttgcctccaattaaaacaaaaattctgtccagggtcaatcccatctactcctgtgtcttctaaatttccaaggaaaattacctaattttctcttctgtttctctctcctttggcctcttgtatctatattaagaaaaaaaaaaagaaactttttttaaagaccacgcctccctggctttgtcctgctcctcctccacccaccatcccaccttcttctgttcacttccttaccactggctctcggcagctctctgtgtgtttccagtgctggattttcctccaagtctgatatgtgctttcacccacttaacgaggcatcgctccactgcttcacatgcatccaggtggagtccccgtgagctccccaccacctcgacttccctgcttccctctcagttgtgaagtccccttccttctcccacactgccctcagtctcatcgctcactatgggatgagacagagggaaatgcactaaacaggaagttaggagccctgagtgtgtgtctcccctgccactgactcactgcatgatctcgagcaggtcgcatgcatgttcttggcgttggagatggagatggtcacatacgctgcacagaaacacggcaaccacattttatgaaccctgtgcaactgcagaaatgttcaatggcatggatccctgattcttcctggattattcttctcatacttgtgccctcatttacctctttatgctcacatttggaacatatttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgac

SEQ ID NO: 1664 - DNA, 5938 bp, Homo sapiens
tttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgac

SEQ ID NO: 1665 - DNA, 7804 bp, Homo sapiens
tttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgactaatctgttctctttcagtattggatacaaatgaccgatttctacgaaaaataaccatcgggcagggaaacacagagaagggccattaccggcaggtaggtggtgctttcttcccgggtgtggctctgttcttacgttcatttctactggcctgggagctcactctttgcctttcttgtctcatccccaacctgttgtggccagtggttctctcactgttttgggtgctcagcagggctgggagaggatcagaagacatagaggctccagtgtctttttaccatcttttctatgtatgtttatttcattttctttttttcatgtatgtttccaattgtgtttccaggaagagccactcagggtattctttgaatataaattctcacttattttattgggaaccatccaggtaatactacatctgcataactgataaatgaaaatctcagacacattactcaaatttcatatatcaaagaacaaacacctagttattagacttaatagcatgaggattttttaaaggataatggcttattaatacaaaaatggcttattaataaaatacagagaatgcagaagaaaaattatgtctgacttcattgtaatagatattggatgtgcgtcaatggcacttagggaatacaaattaattcctatgatttttcatccaggcacagtgggcttctaaattgtgttgtgtttttttttcttttgaattgattataaactgtacatttaagaacagttttagatttctgtcctttatgttaagtttttattagtgaaaaaagagtcaccttactataataaccaatccttacgccaaatagacttgtgaccttttgaagtgtcttgaattaaaaagtgaatgtaggtattggattaagaagagaaacttaagttcgtggacctcgtctcctcccagtcctgtaacttacacacacacacacaaacagatttcaaatatccatgctagcaaactggaatcattgccatgaagttttagatagttctgaaaaataggaagatggaattagattgatgattaaaaggacagcccaaaatatggtggacttccatccttaacaagcattcttgcttttcatgttcttagcctctcctgctaaagtgggagctttataaaagcagaggttattcccctttttatttgctgctgtgttccctatgttcagaacagaactttgttacatatagtcgtaagtgttcagtaaatatctgttgaacaaatgagtagaataagtaaaagacaatttatggatacagaactaaaatgccaacataaaaagatgttcatgaataatcataaaactgcaaattgaaacaatggagtatcatttacctaggagcttgtcaagtgaaaatagtaggtactaaatgctagtgaggatgcaatgaaatgggggcatttatgcagcgttagtgggagtagaaatcctttttggatgagtttgttattactaaaatttgaaatgacccaacaattacaactttggaactaaaaatattttaatgaaaagaacaagaaaatgtgtaacgtacaggaaaaaattctgtgtattaggatatttgttgtgccattatttgcagcggtgaaaattggaaacaatccaaatgtccaacagtagagatggttgcatatatttggtccgccattttgtcccatgggagagttgaaattaataaatgtgcgtatgggtgtcttgacatgagtagagagctctcatacaccattggaaaggttgtaaaaaccattttaaaactttgaagtaaaatactgatattgtaaacctgtttatgttaagaaaaacccagcgtgtttacttacattataggcacttacaa

SEQ ID NO: 1666 - DNA, 4145 bp, Homo sapiens
tttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaata

SEQ ID NO: 1667 - DNA, 5485 bp, Homo sapiens
ttcatgtgaacgttttcacttattttgcactttttagccagagatacagaagaagagagggacactcgagattaaatgttttagtgaaagttaatgggcagcatataacaagcctggggtacttgaaaattcagtaaaaagcaataactagggctggttgttttccctctttgcctttgaatagaaatgcatgcccacactgatggaatgtcaagtgcctgtgctgtaggactacttagcaacctgcccttacaaatctctatcttgaaccagtgtttcttagcattaaaaacaaagggtatgtgtacttaaaccctggagtcagtgtacagaggtctaacttctcacccaaaatcgtgggtcatataatattgtggccaggagagtgcttataggaagtttcaaaattcatttagttgatatattgtggtttgtagtgtacctaggaacattacattattagtaagaggcacatccattataagctcttgggaaggtgtatatttcaacttaacacatttgcagttatatttgaaatgaatgtgtttgcctataaggactcacttagtatctttagttcctatttaatgctaaacttattctgtagacccaaatatttctaagagccttgcatagaggcacctgggatattctgttacaaatatctgttctgtctacacagcttctccaccttaagtggtttaactggtgctttgcagggagtggagaaaggatatctcagaaggtcaaaggattaacattttcccacaaagtctttgatggaaagtctaagaccaggagaagaggagtaataacatgacctattattctgtaatttgcaaattcatgaagggcttccatatataaatttcacgtgtatgtgtgtatgtgtgggtgtgtgtgtgtgtgtgttaaaacctgtgaggtaactataacaggtattattgtccctactttttaaattaaggaaagcaagtctaggtcataggctaagtcattttcccattgtcacctagtaaagtggaccctccacccaggtgttaggatctgaagttctttgcattgttcactttgttttcctcaaacaccttccccttgagcctggagactatatctttcagtctttttacttaaatttctttaagtggctgctgggggtcagtgggaagatcaaggcagtaacaatggaacaggtgtggctgatggaaggctgagatgtcctcagcagcagaacaggatggacaggctttcacactgtttattcatttgtcccctggcaaaacactccttttggtgagccgccttgactgttcccctgggtgttcgcctgcccattgacattcttccccatatttccttgctgctgctctcttctatgtcccactgctgctgctgctggataccatgtttggcacagtaaatcctagagcaagtgatttttcacccttctgttgaacaaggaagtcagggttaaaacacagtaattatatggcggtcaagtgcaagagaggagtgactgcagaggatccctgttcccagataccttttattcctgaatttatactaaatcatgagcatttgtgcatgtcttttaaatatcatttgaagactcttttcatgattctgcacattctatcgcataaatttagcaacatttatttcagtgttctattttgggtatttaggttattttctagtttttgctgtgatgaatattatagaaaaaattaactccttggagaaaaaaactgttaactatttgaagagatacaagtctggtttaaatggtttgccctagtcattgattcatcagtacattgtaagttatttataaccagataaatacatgattagttttctgaagtaatataatagtgatactagttttattttcaggtggaaaaaatgagtaaagatggtcaataacagggatagatttcacaattacatcatcaatattctgaccctagaattttacttttggctcatgcttttataaaaagttggtgcaacagcaatatttttaatgcagtaagttgatacataaatgtataaatctgaaaaatctaaacccagttgtaaataatcaccactttgtaagagtcgttgcttcagtggctggcttaagtatttttggtggaatgtactcctcaacatttgaacttgacttttttttggtcatgcatgtagaaaaggtttaccgattatgagcaaattagtagaagttgaagaaccaattacttagaggtttatttcctggaactactgccttcaatttcttgtgcagttgcatagagaggaatagggtgaggcattacaggtttccataaagctatcagtccctctcttaacttttcagtcagactcacatcttcacccactgtccaacatccagacacaacaggcagtgagcagaccaactttgttcctggtgttctccctcttctctctgggtttcttttttcttttcagtttcttctctgggcttctttttttctattcagtttcttctctggttttcttttttctattcagtttcttctgtgggtttctttttctattcaatttcttctctgagtttcttttttctattcaatgtcttctctgggtttcattttttctattcaatgtcttctctgggtttcattttttctattcaatttcttctctgggtttcttttttctattcaatttcttctctgggtttatttttttctatttaatttcttctttccccaggggaccagtgccttttttcctactccaacctccttaacatggcatccaccaaggcccatatttttgaggtctcattgtctttgggataatgtctttgggacaatgtgtctcttgtctttgggaagcaagttatctttgctgtccccagtcagcaggaagtcacctgactttcccaaatttgacattatcttttccaggtatgtttgcttttaagcgtggtcctagaaatgtcactgccttaagcttactttgattgtgtggctagctcagtgcaagggtcacagcgttctgttctagttttgggtaaactttgatggagaggaccactaggtaaaaatggaattaggaactcatatttttttttttaaaggagggggcctttagggttagaaaatagtgttttttcttttcctgatctatggtggctgaaatgtgtgagcatagggaaatctgacttgaataaactcttaagatgaagtcatacataattaattgcctgtctctgcattctttccaaagtgatggctcttagtattcacacttgtgataacttatgtttcttgagtacaagagcctcaggacagccaattaaggaagaagacacagtggtggttctgttatgtaacctttctgctactgtaatggaatgggcaattgtcttttttttcttaacttccagtgcctgaaacagtacatgcagctggcaatccgagaaggatgtgggtctcccatcacttgccctgacatggtgtgcctaaaccacgggaccctgcaggaagctgaggtatgaatgactaccatcatcttcccctctttcctatttatgttatttattaggatcttgagtctttatgtatttccctaccagggagtctagcaagaaaatacagaggttaactttttaaaggagcactttattgcagcttacctttggactttttatacaaactgttaaagctgtcatttatctcagttctatttacatataccatcttgagtgttgaagaagctatagaataggcaaagtaccagaaatcaaatttaccaaatgtgaagttaggaggctgatatgatttggctctgtgtccccacccaaatctcaccttgaattgtaataatccccacgtgtcaagggtgggaccaggtggagataattgaatcatgggggcggttcccccatgctgttctcgtgatagtgcgttctcctgagaactgatggttttataaggggcttccctgccctttgctcagcactactccttgctgcggccatgtgaagaaagatgtgtttgctttctcttctaccatgattgtaagttttctgagaccttcccaggtctgcagacctgtgagtcaattaaatacccagtcttgggtatttcttcatagcagtgtgagaatggacacatacagaggctgaatagtgaatggtcttgtaaattgtaataccctaaagataaatagaccatggattagctgcagttatggaaaatataaactattgtgattccacaatgatagcctgagttgaaccatttccaaagagtagagacctttcaattgatctgtagcaggcatctgaaatctttttctttttttttcatatcccctcgtttgttcaatcaccggttattggtttgcctttaaatcttcagactctgctcactttaaattagaatataatgaactcttgtttattcttagggtgtttgtaagcctctgaacgacatcccaagaaacagatgaaatcagttgttcatttagcaaacacagaacacctgctttgcaccaggcaccaccaccccccagttgttttcattgccagtatactacctaatcctctcaacagacctcatgaaattgggtgttgctttcagatagggaaactgaggcccagaaggtttaagtaacttacccaaaaccacatatctagaaagtagaagagataggattctaatccattgctttctgactgccataattacgtggctttgagtagaattaggttggccaggtgctgtggctcacacctgtaatcctggcactttgggaggccaaggcagaaggattgcttgagttcaggagtttgagaccagcctgggcaatatagcaagacccccatatctacaaaaataaaaattagaaaattagccaggcatagtggtgcatgcctatagtcccagctactctggaggctgaggtgagaggattgcttgagccctgaaggtcaaggctccagtaagccttgatcacatcactgcactccagcctgggcaatagagtgagatttcatctcttaaaaaaaatgggaatgggggcatagaactaggtaggtagatagaatgtatgataaaggacttaataattggaagctcaatttgtgtgtgtgtgcagacacacatgtagatgtgtgtgtgtgtatagatatatatactgtacatgctttgtttatgaatatatattcttttacatatatatcctttgctttgtaagtgaagcagtcagaaagttagtatagacagtttttaacaatttgtgtctgggcatcctgtgttcaatttattgattagtggctgagtgctacaagtgagatataacgttttttagggaagtataaaaggaatatctgtttagaagtgatttaagaaaatcatggaataacttttttggtaaaaaggtaatatcgagtatgtaaaccctgtggagagatatattattgacttttgtagggtaaaaagagctatag

SEQ ID NO: 1668 - DNA, 2166 bp, Homo sapiens
gccatctctgtaaaaacgctaattgataaccgagtcatttacatgttttcgaacacagaatagctcttttctcagcatcattattgctctttcagcatctgttaggacagtctgaatactttctgtttcaaggcactgataaaaccgcaacaaaaacatgtaagaaataaaatagaaatgctttatataatttagtttaaatttatgtatcacctcattgtgacttattttttccattataccattagtcagatttgaataacgaggttttgaaaggataaaaccttttctccaatgacaggattatataattgctattggcaatgtagcctggtgcttcatgagacctatgctaaatgttactggagagttcttgaagccagggataccatatcaggaactattcaggatctatgatattttctgaggtaactgggtaatagaatatcaaattgctgctatctcggacctattgttaaaggatgatgctttgcctatgtaataggatatatcctaagtggggatgtgtatatttcaggaactttaattcacaagtatatattgatatctgatgtgtgtatagtacatctgttggttatgtacattttaatttacatgttgtgtagaacatagatgagaactctgggaaaacttgggaatggcaaccaaccaaaatcatttttaatcatttattagaaatttctcaatattgtgtctttttcttttgaaactctaaacacttcagaaaaaaacactatcagtgtagttcatgttagtataattatagatttacatatatttgaatagttaatttgctttgttttacacgtagcccactgcctcattataggtaaaaggcatttataactgctcaggggattacgagaactcaactgaaactgaatttttgtaacaagaatgttaatagtggcaaagtcctctgtcagtaaactctttaagcttggtgctgcaaagagtctttaaatgggggctgatttcaagtaacctaaaagactgtgttatcagaggaagaggtcccaaatttggagtaaagatgggagaaaataaatatgtgctatttccttggcgagttgagggaatttgccaccttacagagtttgtatcactgaattagctgcttttgtttttttttttttttttttgccagggctatggagtgggggttgtttgtcaaactgattttcaataattggatttaattttttttaacattgaaaagtgcctgaaaaatggtaaattcttaaatgtgtgtgagattgtcagaatcaacaaaactaggttggttaaacatatctctggtacatcaaggggcatgatacaaaccagtctaaagactgtttataaaggagagagctggcgacttatttttatttttattttttggacagagtctccctttgtcacccaggccggagtgcagtggcatgatcatggttcacttcaacccctacctcctgggctcaagtgttcctctcaccttatcctcctgagcagctgggactacaggcacacaccaccacacctggctaagttttgtattttttgtagagatggggtttctctgtgttgcccagtcttgtctcaaactcctgggctcaagcgatccacccaccttgggctcccaaagtgttgggattacaggtgtgtgtcactgtgcctgacagctgacagttttaactgacaactttgataacagaggctgctatttttgttttagataattggccagtgacagagtttacccttgcctcctttcttggtctgccagctttgtcctttctgagtgattctctttctgtattgagaggaagtgtgggtctacatagggatgtttggatgctatggcaagaatctttttgtgtttggagtgtagtccatttgcaatagaaataaaaaaatccgtcaccaaattgtaacctggatgttatagcccagcatctagaaatcctatgaaacgtattagcacaatatcttgccattgtcccatctaggaaattttttcttgttgtgaggtagggaagtgaggaggaaagccatgccgaagcaaatgttagaatcttaggcatcctatttgttcatgccatgggtatttgctttggacttggagtctgtactttgaaagaggcctttgaaaaacaaataatt

SEQ ID NO: 1669 - DNA, 9129 bp, Homo sapiens
agccattccttttcaagaacattacatttcctgatatatttcataaattgcaaatgctcttaaacaatcagactaatatatccttcctatcatcattattcatattaacctatcctcacagaaagaaacctctaagagatgaaaaaaaaaaaagtgtaagaagcatgtcaagaggctaaaaaccactacttaacaaaacaatctttttttctttttcttttttttttcttggagatggagtctcactctgttgccaggctggagtgcagtggcatgatctcggctcactgcaacctccgtgtcctgggttcaagcaattctcctgcctcagcctcccgagtagctgggattacaggcgtgtgccaccacacgcggctaatttttgtatttttagtaaagacgggatttcaccatgtttgccaggatggtcttgatctcttgacctcgtgattcgcctgcctcggcctcccaaagtgctggaattataggcgtgagccaccacacccagccttttttttttctgagatggggtctcactctgtcacccaggctggagggcagtggcatgatcttggctcactaaaatctcaaaatctctgcctcctgggctcaatgaattctcccacctcagcctcccaaatagctgagacaacaggcgtgtgccaccatgcacggctaatttttgtattttttgcagagatgggttttcaccctgttgcgcaggctggtctcgaacgcctgagctcaagagatcctgccacctcagcctcccaaagtgctacgattacaggcgtgagacaccaagtgataaggtttgacaaatctcatcttgaattgtagctcccataactcccccatgttatgggagggacacggtggaagataattgaatcatgggggcagtttcccctgtactgttcccgttagtgaataagtcttacgagatctgatgggtttataagtggaaacacctttcacttggctcttattctcttgtttgccaccatgtaagacatagcttttgccttcttccattattgtgaggcctccccagccacgtggaactgtgagtccattcaacctctttttatttataaattacccagtctcaggtatatctttatcagcagtgtgaaaatgaactgatacaccatgcctggccaaaaccaaaatcttcttaactcatgttccacatttaaatatatggtagcagtggtgaaggagagtgaagagaagttttgaattgttatagtatacatgcacacacaggttcacacgcacacacaaaccattttgtaaggggaacatttattttaaatcttagccatgtgttaattttcacttaatatttgtaggaacattttcagttacatgttcaacataataccattttaatactagtattaaaaatgttttataaccctttataacacaggaaaacacaggtttctaccaatgggcagaacttgtcatcatgggggattccagtaaaagactatttcccaatctgctacgtacagccgactgcctaaatttggaccaatggatttggtgtgtgtgtgtatggtaggaagttgttttctcctctctaggttttccttctcactgacgagataatagcaacaaataaaggctcccatctttaattcagatgaagaagcctcctgatgagaaggacagagctgcctggccagcttcagacaggtcatttctagattgctgtctgagtagaacagaaatgtctgttatttcagcactgaaatttgaagatattgttatagaaaattttaacacaaaagtctaaatattcagttaaattatttgtaggaaatagttcaatcaatgtcattagtcaaggcaaaaatctttgtcataagaattaggggataaaaacaaaatcttaaaaatatgtacacatgaatttttatgtatatgctcatgtgacattaaaggtctctccaggcattacatcagcagtccccaacctttttggcaccagggaccattttcttccatggattggggtggtgaaggtggatgactttgggatgatacaagaacactacatttattgtgcactttatttctattattactacattgtaatatatagtgaaataattatacaactcaccacaacatagaatcagtgggagccctgaacttgtttttctgcaactagatggtcccagctgggggtgttgggagacagtgacagatcatcaggcattagattctcataaggagcacgcaacctagatgcttcacaggcacagttcacaatagggttcatgctcctataagaatctaatgccactgctgatctgacaggagatggagctcaggcagtaatgcgagtgatggggagtggctgcaaatacagatgaagcttctcttgcttgcccactgctcatctcccgctgtgcagcctggttcctaatggtaccattctgtggcccaggggttggggactcctgcattacatcaaagtaaaaatcacacacacacaaagaccaagatacttacagtaataaattttctaaatagttgaatgtcaacactatgataaacaaaattgcaatgcaactaactggagaaaaccaatttagtttagggtttttgtccataatacatgaaaaagctcttaaaatgggtaaaatgacaaagaacattgtattaatagatttttggttgcaagccacagaaaccaagactctggttaacttagatgaagtgaattactgtaagagtatgggaaagttaaatgaaagaagaaacagatgcagaaaggacaacggaagtagttccagagggtgctgctggcaggaactaccatactgtcttccctgagtactgccactggaatggacagttccttagaaacagactgaggtggcatagagatggcatagagaaagcatagagaaatggcatagaggaagtttgattgagagtatactcaggagacacaactataaggaaatgaggaaggcaggattgggcagaggaagcagcagactcacagtgaggatgcagctgaagcctcagtccatcctacagggtgttctttgaggtagtggctctttagattgtcccaaatacagtcaatgccctttatattgaccatcagctagtcagtggccttgggttgccctcaggcaaggcagttgcccagggagggaggaagtgagatataagcaactaagagtcccacaactggacttacttttctgactttgcatcacaccacccaaaattcaaaacacttatgagagccagattggcacatttggtcatatgctcacaatttggctggggcaggcaagctcctctattatgtccttccaaaactacacacagagaggtaattccagtaaaagaattacccccacctcaccaaagaaacaaaacaaaacccaaacaaaaacaacaagaaaaatgtgtatgctattaccacaacaagagagaatggaaaccccacttctaggatacagtaatggtcttctatagatatcaatgggcaattcagaaataaaaatatataaatgattaagaaactttaaaaactataacctcactagaagtcaatgatctgcaaattaaacttttgttgttttttttttttgctaatcagattgacaaagattaagaaagattttactctgactttataagggtggtggaaggcagaaattcaaacacaatgttgacagaaggataaattgataataacctttctgaaaatcaattttgatatgtatgccaaaagttttaaaaatatacataccctgctatttcacttctaagaatttatcctaaggaaatactcaattaagaaagatatatgcacaaagacatccaatgtagcactgcttgctcttatttaaaaatgaaataaacagggttcaaaaataggtgatagagtcagtaaattatgataaatctacatgatgcaatattatgaagccattagaaatcatgcaattgcaagatatccattttcatatatagagaaatgttcacattactggttttaaaaactataaaacataccataaatcattttgtaataccataaacaggaaaatgttatttcagggtgatggcattataagtgttacttccttttgcttttttcctatgacttctatattaattattactttataaatagaaagatgttataaataataaatatctacttgacttatagatattaaattcttgatatatatcctattatatatcaagaattatatattatatcaagaattatataatatggaatatatatcaataatatctatctatattatataatatatattaagaattttatgtctctagaaattggttacaattcaaccaggcatggtgggtgtctcagcctgtaatcccagcactttgggaggtcaaggccggcagatcacttgaagtcaggagttcgagaccagcctggccaacatggtaaaactccatctctactaaaaatacaaaaattaaccaggcctgttcgtgagcacctgtaatcccagctacttgggagattgaggcaggagaatcacttgaacccgggaggcagaggttgcagtgagccgagatcatgccactgcactccagcctggacaacagagagaaactcagtctcaaaaaaaaaaaaaaaaaaaaaaaaaattggttacaattgaggtggaattttagttcaaatctcttaaaaaacaagaaacatttcttgactaatcagaagagctgatactcagggccatattcaaagtcagctggtacttcagttttaaatgaaaacaattacatgaaccgtaataacctgcctttaccttcatactcatgtttttaaaaactgccatattgaacctaatagttttggcccacatttaaaggaagattaaattacttggaaagggcccagaggacagtaataaaaataattacatacttagaaatttggtcctataatgacatgcaagaggaaatcatttagaaaataaaactgaaaataaccttacacttttacgggttaccataacctctgaagaatgggacaagaagccaaagaattgaattataatgagaataatttaatttagtcattaggaagaacatcttattcctcaataagtatttgagtgattattaatgtccaatgctatggcataaggacttgtaaccactaggatgtgttactagaaattattttcttaaaagtgtcagaggtagaatattgtgcaaagtaggggcttattacataaccctttaagatcttttccatatttatgatttttacaaaatttcaggcatctagaataattataaaaacatatcttatttttatggctttttaaaagtgaaaatagattaataattaagaaatataagaggataaaaatattagagatttttcattaacattgaggaaaatataagtatacagttagttaggaaacgcattatattatttgactccataaaggggaagcaattaaactaattattaagatatgagtacatgtgtgttaagtgtcagtatttgtattttaaatctctttttttttaaagtatagtgcaatgtagtgaatgcagacaaaatgttcctataacatatctgtacagatttttttctaagacgggagtcttgctatgttgtccaggctggtcttgaactctggggctgaagcgatactcctggcttagcctccctagtagctgggactacaggcacacaccaacttaccagtaacacattagttttaaggggctcagatgaaggaaaataaaatggatttaagatgagtaaaaaagaatcctcctttgtctgggcttgttccatcttccaaatatgtagcagcaacataatgacactaaaaactgccctaaaaatctgtaacagaaaaaaaaaatagcttacatgctactcaaaaaattacctaaatacctctcaaaatcaaaacaaaaagcaaagtaaaaaataaaacaggacatacttgcaagaaaagatatgacctaaaggttgtatcttagccctgtttgttttttgaataaaatattaagttttaagcatttatttactgtttacatacattaggccttaccatattatcaggcactattctaagtattttacgaatagtactttatgtaatcctcatagctccacaagtatgagggtgtggtggctcatgcctgtaatcctagcactttggaaagcagactgcttaagtccaggagttcaagaccagcttaggcaacatggccataccctgtttctacaaaaaacaaaaaaattagccggggatggtggcctgcacctgtggtcccagctactcaggaggctgaggtgggaggatcacttgagcctgggagatcaaggctgcagtgagctgtgatcttaccactgcactccagactgggtgacagagcgagactctgtctaaaaaaaaaaaaagctaccattgttataccccattttatagattaggaaactgaggcacagaggtcacactaagccaagatcacacaacaaatagcggagctgatggagctgagattcaaatccaggcagtctggtgctggagtccatgtgtgtaatcactaagctattatatacaagtaattccttcaaatattaatatttgataacaattttgaactttgaagtttgcaaatatccacagcctgtatagttagaagtacaaaagtaatcacaaataacttttctaatacagattttaaattggaaaagatttctttgaatagctttacaacaaacatgtgtagacaaaagtagggataagaaagaaagactgttttttaaatgcatttgtcatgaatttactacctgggtaagcaaaaaacttgagctgtctcttttgaaagacataatttacaaatatgaatttatatattgtctagaggaaaagcacagtacaatttcaattaatgtttaattctatgactgactaaaatctttataatatttttaattaaagaagaaggtgaccgggacttaggtaagaaagcaaaattataacatttactacataacaagttttttgtttttttttttacataaacaagctttgtttcttacaaaaaaaaacaagcttcttcttttttttttttttttggatacagagtctcactctgtcgcacaggctacagcatagtgccgcagtctcggctcaatgaggcctctgcctcccgggttcaagcaattctcatgcctcagcctccctagtagctgggattacagacatgcaccactacacccaactaatttttgtatttttagtagagacagggtttccccatgttggccaggctggtctcgaactcctggcctcatctgatccgcctgcctcggcctcccaaagtgctgggattataggcatgagctactgtgctaggcctataaaaaagcttctttagggtaacttttttcttttttctgtaacagaataatcacattatttctcaagggaaataccatttactcaatttgtactctgaatgccatctaataaaacagcaaagccacaaccatgcagaatgtcagcacagcatgtctaactaaaactcactgtaagaaaaaaaaggaaaagagagctgatttcaaaggttctacatggctttgcacttcacatgctctgatgctgcagatatgagaagttgtaggtctaacataatttatatcttcttttaggatactttggcatttgtgaattgagaagtttggaaaacaactacgcaagtcacttctaatcctaaaattccaactacatgaaataaatattagtaagtactcagacacacacaatgtcaaaggctggccttgtggcaaaaaggaaatacagcaaaatcagtcaggttcccaccacggcactgatagcaagtctgttctcaaggttagtctctaaactgacacctggtaagtctgacaatgaaatatttgccaacaattaagtaaaggagatctctcctgataaatttttcataagtttcacataatacactttgatatttcctggaatgtttgtggccctcccctcactgcattgctctctcattttgttggctaatacatgttactaaagtcaatatatattcaactcatttttctctgcctcttggcccaatttaacacagctgatcctgttttcaaatgccttcatctgattttcttctcacctcctgacctttgtaggtcttttatgtgctcattaatgttggaattacttattttttccttaaccaagtttttcatctgtaaaatggatgtaatcttatgattttcttcatagtgttgcgagaattcagtaagattatgaatgtatagattttggcacagtatccaggacctaaattctctataaaggctaactactattactactatcaactcacagctagattagtgaaattgtgtcctgactttccatgcttattcttcctcttctccactcttctgctcataatataactagttttatttttatttatttattttttgagacagtgtctcactctgtcgcccaggctgggtgctgtggcacaatcatagctcactacaacccccacctcaagtgatcctcccacctcagcctcccagggagctgggaatacaggtgcgtgccaccacgccccactaatttttgaatttttgtgggtttttttggtagagatggggtttcattattgttgtccaggctggtctcgaattcctgagctcaagccatatacccgccttggcctcccaagtgctgggattacaggtgtgagccaccttgccaggcctagagagttttaataagcacaaatctgattatgtgcccctcaatctatccagaaacccattaatgcttttatagggcttttagaatacagacacatctcttactacttttgcccccaatccttccctatgctttaaccaaactgatttcaagcttcttgcttctttgatagtccctgctcactccatgagggcatttgtccacaatatttcccttgttggaaaccctctagtgacaatttggtcctaattttcctttagacctttgctaaaaagtcacttctgtcttgactaagtctggcctattttgcattttccttata

SEQ ID NO: 1670 - DNA, 1588 bp, Homo sapiens
agccattccttttcaagaacattacatttcctgatatatttcataaattgcaaatgctcttaaacaatcagactaatatatccttcctatcatcattattcatattaacctatcctcacagaaagaaacctctaagagatgaaaaaaaaaaaagtgtaagaagcatgtcaagaggctaaaaaccactacttaacaaaacaatctttttttctttttcttttttttttcttggagatggagtctcactctgttgccaggctggagtgcagtggcatgatctcggctcactgcaacctccgtgtcctgggttcaagcaattctcctgcctcagcctcccgagtagctgggattacaggcgtgtgccaccacacgcggctaatttttgtatttttagtaaagacgggatttcaccatgtttgccaggatggtcttgatctcttgacctcgtgattcgcctgcctcggcctcccaaagtgctggaattataggcgtgagccaccacacccagccttttttttttctgagatggggtctcactctgtcacccaggctggagggcagtggcatgatcttggctcactaaaatctcaaaatctctgcctcctgggctcaatgaattctcccacctcagcctcccaaatagctgagacaacaggcgtgtgccaccatgcacggctaatttttgtattttttgcagagatgggttttcaccctgttgcgcaggctggtctcgaacgcctgagctcaagagatcctgccacctcagcctcccaaagtgctacgattacaggcgtgagacaccaagtgataaggtttgacaaatctcatcttgaattgtagctcccataactcccccatgttatgggagggacacggtggaagataattgaatcatgggggcagtttcccctgtactgttcccgttagtgaataagtcttacgagatctgatgggtttataagtggaaacacctttcacttggctcttattctcttgtttgccaccatgtaagacatagcttttgccttcttccattattgtgaggcctccccagccacgtggaactgtgagtccattcaacctctttttatttataaattacccagtctcaggtatatctttatcagcagtgtgaaaatgaactgatacaccatgcctggccaaaaccaaaatcttcttaactcatgttccacatttaaatatatggtagcagtggtgaaggagagtgaagagaagttttgaattgttatagtatacatgcacacacaggttcacacgcacacacaaaccattttgtaaggggaacatttattttaaatcttagccatgtgttaattttcacttaatatttgtaggaacattttcagttacatgttcaacataataccattttaatactagtattaaaaatgttttataaccctttataacacaggaaaacacaggtttctaccaatgggcagaacttgtcatcatgggggattccagtaaaagactatttcccaatctgctacgtacagccgactgcctaaatttggaccaatggatttggtgtgtgtgtgtatggtaggaagttgttttctcctct

SEQ ID NO: 1671 - DNA, 3228 bp, Homo sapiens
tctaggttttccttctcactgacgagataatagcaacaaataaaggctcccatctttaattcagatgaagaagcctcctgatgagaaggacagagctgcctggccagcttcagacaggtcatttctagattgctgtctgagtagaacagaaatgtctgttatttcagcactgaaatttgaagatattgttatagaaaattttaacacaaaagtctaaatattcagttaaattatttgtaggaaatagttcaatcaatgtcattagtcaaggcaaaaatctttgtcataagaattaggggataaaaacaaaatcttaaaaatatgtacacatgaatttttatgtatatgctcatgtgacattaaaggtctctccaggcattacatcagcagtccccaacctttttggcaccagggaccattttcttccatggattggggtggtgaaggtggatgactttgggatgatacaagaacactacatttattgtgcactttatttctattattactacattgtaatatatagtgaaataattatacaactcaccacaacatagaatcagtgggagccctgaacttgtttttctgcaactagatggtcccagctgggggtgttgggagacagtgacagatcatcaggcattagattctcataaggagcacgcaacctagatgcttcacaggcacagttcacaatagggttcatgctcctataagaatctaatgccactgctgatctgacaggagatggagctcaggcagtaatgcgagtgatggggagtggctgcaaatacagatgaagcttctcttgcttgcccactgctcatctcccgctgtgcagcctggttcctaatggtaccattctgtggcccaggggttggggactcctgcattacatcaaagtaaaaatcacacacacacaaagaccaagatacttacagtaataaattttctaaatagttgaatgtcaacactatgataaacaaaattgcaatgcaactaactggagaaaaccaatttagtttagggtttttgtccataatacatgaaaaagctcttaaaatgggtaaaatgacaaagaacattgtattaatagatttttggttgcaagccacagaaaccaagactctggttaacttagatgaagtgaattactgtaagagtatgggaaagttaaatgaaagaagaaacagatgcagaaaggacaacggaagtagttccagagggtgctgctggcaggaactaccatactgtcttccctgagtactgccactggaatggacagttccttagaaacagactgaggtggcatagagatggcatagagaaagcatagagaaatggcatagaggaagtttgattgagagtatactcaggagacacaactataaggaaatgaggaaggcaggattgggcagaggaagcagcagactcacagtgaggatgcagctgaagcctcagtccatcctacagggtgttctttgaggtagtggctctttagattgtcccaaatacagtcaatgccctttatattgaccatcagctagtcagtggccttgggttgccctcaggcaaggcagttgcccagggagggaggaagtgagatataagcaactaagagtcccacaactggacttacttttctgactttgcatcacaccacccaaaattcaaaacacttatgagagccagattggcacatttggtcatatgctcacaatttggctggggcaggcaagctcctctattatgtccttccaaaactacacacagagaggtaattccagtaaaagaattacccccacctcaccaaagaaacaaaacaaaacccaaacaaaaacaacaagaaaaatgtgtatgctattaccacaacaagagagaatggaaaccccacttctaggatacagtaatggtcttctatagatatcaatgggcaattcagaaataaaaatatataaatgattaagaaactttaaaaactataacctcactagaagtcaatgatctgcaaattaaacttttgttgttttttttttttgctaatcagattgacaaagattaagaaagattttactctgactttataagggtggtggaaggcagaaattcaaacacaatgttgacagaaggataaattgataataacctttctgaaaatcaattttgatatgtatgccaaaagttttaaaaatatacataccctgctatttcacttctaagaatttatcctaaggaaatactcaattaagaaagatatatgcacaaagacatccaatgtagcactgcttgctcttatttaaaaatgaaataaacagggttcaaaaataggtgatagagtcagtaaattatgataaatctacatgatgcaatattatgaagccattagaaatcatgcaattgcaagatatccattttcatatatagagaaatgttcacattactggttttaaaaactataaaacataccataaatcattttgtaataccataaacaggaaaatgttatttcagggtgatggcattataagtgttacttccttttgcttttttcctatgacttctatattaattattactttataaatagaaagatgttataaataataaatatctacttgacttatagatattaaattcttgatatatatcctattatatatcaagaattatatattatatcaagaattatataatatggaatatatatcaataatatctatctatattatataatatatattaagaattttatgtctctagaaattggttacaattcaaccaggcatggtgggtgtctcagcctgtaatcccagcactttgggaggtcaaggccggcagatcacttgaagtcaggagttcgagaccagcctggccaacatggtaaaactccatctctactaaaaatacaaaaattaaccaggcctgttcgtgagcacctgtaatcccagctacttgggagattgaggcaggagaatcacttgaacccgggaggcagaggttgcagtgagccgagatcatgccactgcactccagcctggacaacagagagaaactcagtctcaaaaaaaaaaaaaaaaaaaaaaaaaattggttacaattgaggtggaattttagttcaaatctcttaaaaaacaagaaacatttcttgactaatcagaagagctgatactcagggccatattcaaagtcagctggtacttcagttttaaatgaaaacaattacatgaa

SEQ ID NO: 1672 - DNA, 1828 bp, Homo sapiens
tgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttc

SEQ ID NO: 1673 - DNA, 101061 bp, Homo sapiens
  misc_feature (512)..(100511): n is a, c, g, or t
ctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttatta

SEQ ID NO: 1674 - DNA, 3481 bp, Homo sapiens
ggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactctttt

SEQ ID NO: 1675 - DNA, 42920 bp, Homo sapiens
tactggaccgactgggaaacaaagtccattaaccgagcccacaagaccacgggcaccaacaaaacgctcctcatcagcacgctgcaccggcccatggacctgcatgtcttccatgccctgcgccagccagacggtgagcaggcaaggggtgggagcaggcgaacggtgagccaggcaccggggtccctgggagttcctgctcatcccttctctagcattgaccaagccctcctggccagacactgggagactccaggagggtctagacaggggatggtctggctcccgggagcttcagcccggcctggatccagccctggagtctggcagcagcaagtccctgaggccagtcaagtgggggtctgggtgcccagcccccagaaggaaggcaggccggcccctgggagggaagcacagaggaggtggggagctggccttcaggcctggcctgatcctgggaccttagaatcctctcctatctccagcttcagctccctcctaaaagaggcagggttcagacccacccgcctctgtccaggatagagtgagtgaggcagcctttggtaggccagaaaatgtcaccatatttcacgacgttttctctggcagtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccaggtgaggctgtcccccagaccccatcaccagtgcccgctccccaacccccaaatcctccttggaccccaacacctgctctgtcctaatgtcctcatgcatctggttttcccacactaacacccccacatttcttgcctacctcttgtctccccacagcaatacttttacccccgtcacctcacacagacacctccacaccctaaccttgaccctccttgccatgcttcagtgctgccttccccaccctatcccacgcagccccatacctggcctttccgaactcaccatagcccaacctgccccataacaccctgacccctgcctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggagggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggcttggagagcgtcgtccggctgggctccgcggcgcccccactccaggtgcacgggcccggagcccagagccccacgccctgccccgttcctcctgggcgcacagacgcggcctctcgggggaccagtgcctgagcccctcgaccccctccgcttcgcacctgggccaggggcgtgtccggggcgtgccggtgtgaaagtcaccttcggtgcccccagctgggcgggagggggcgcgcggggcgcggccgggattggagcgccgcggagccccgccccccgcccgcggagtcagacccaactttctcccccgcccgcgccccgcccccagcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggaggatcttattttattttattccatgttcccatttctcggctctcgtttcctcacagactctcacccctccctgtctgaactcccctacaaggtcgcttcagccgtgcccccccaactcttcctttttatcttggctgtctacagtagtgggtgggggcgggactgcccaaagccaggggattcgccaggatcagagaagcacagacggcactttgtctgagatcagagatgggggtgacaccctggaacctctccttaccctgctgaacctcctcccctccccctgccccttacttctaccccctgcccctgtctggtagaagtcactggcctgaatcaccccagccaggttctgactgggtacaagacataggggtgctctggtctgctgggaggagatggcttggaggcatttggggtcataacatctgatggcatggggataggggggacctggatgactgggcttctggaaagaacagcggttgggtgagattagggaccagagttcaaatggcccacccttcagctttcccaggaaacctaacctccctcccccaatgccctctctcagattcaggccctgccctctccaagcccacttctggggcctcttctccctcccactgtaccctgggacccctccctccaccctctctcaggcccaccctccaggtgttagctgctggcttaagcctgtctgtgggagtcaatcattcttgctgcccccgccccctcacctgggctgagaggagggatggatgggagggggaatgaggggggcgataaatatgtatgacgagcgggtggtggcagcattaataacccgggatcgcagcgtggcggggacggggaccaggcggtggagattctagcccagcagcttggctctgctgttcctgtccccagtgacactgtgtgtgtacacatgggtgtgggcaaacagaggggggcacccatgcttcctggcctccttacctacccacagcacagcctgtgggccagtgtaggacacctccccagagaccactcagatacaattgacatgcatgtatgtcacccccatcggaacacagcaagaccacacttgttctatgactacggatacaccccctttagaaagagcttgacacttgggcagaggatgacaggggctcacacaggaaaggtgacacctccagacaaccacatatagctaccctcagaccgctatacacagccatatagccaacccagacacgtaaccacaccagtcacacagacaccactccacaaattgacacacacacccagccaatccaggcacatacacacagtcaccgatttacacaacagacatgcagccacgacaagcagccacacacacacaggctcctcagactcataaccatgggcatccagatacacacccacacagccaccacagccacacacacatgtaccggccacacacacacaaccatttggggctaacagagacaccagaaccccaggctgacacacatggtactgcctccccccatgggacctgtgcacagtcagggccacagcacgcggcggtggtggctagctcaggctgactgacacactctgacatgcagctcctctcttgcctgctcccctcgctggagcggcatctccatatttcttcctcttgcttcctgtctccttcactcctggccacccccactcacccctaccccagataattgatggcccgggcctggcccggccgctcctgcctctcgatccatcttgtcctcgagcccatgctgtctccaagatcggtggccacctgagacacatagaacgggtgggagcaggagggggctccttagcccccttggagcccaggaaaagaacggccaggcggcctccaccagagtggagcactggcgactgggagggatacccaggctttcctcctctgctcaactggttcccagcactcactccttgcaggccagttggggctgaggcccaggtgggggctctggtctctgaggtcctggagcctctttctttttctttttcttttcctttccttttttcttttcttttcttttttttctgagagggagtctcgctctgtcgcccaggctggagtgcaatggtgcgatctaggcttactgcaacctccacctaccaggttcaagtgattcttccacctcagcctccccaatagctgggactacaggcgcaccccagaacgcccgcctaattttagtagagattaggtttctccatgttggccaggctggtctcgaactgaactcctgacctcaggcaatctgcccacctcagccccccaaagtgctgggattacaggcgtgagtcaccgcgtgtgccgggcgggagcctctttcttgatgctggatgttaatgtggtcacagcctccctggctcagtttgctcagagtccagtccctccctggctcattactggaaccaaccaggtgccgggccaggaaagatgagccaggatccagagctccactccctactcaccttcacactggctttgggtttttggccctcattggagctctgtgggccacatcaggattcttgacgtcatttcacagatgtacaaactgaggcccagatccatgaagtgactgggccaagactacatagcttgaaagggctgcagttctcctccaaggcacgctccctgcccgctgcgggactgcgtgattccatttggtctcctagcggctgtggaaagggactggcgtcgatagggctctggcaggatggcgggggacaaccccagcgtctctctctcctctttcttcgtgcacaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggcccgggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaatacacgcctgtgtgagacctttgtagggaatggggaggtggcgtggggcttctatgtggtagagacctggccaaggccttctccctcagcggctcttggggaaaccaagacaaagactgacagagctagcaccttggaagtcaccaaagaccagatcaaagagagctgagggttaccctcggggtaggagccccgcctgaggttgggattctcctccctgaggtgggcgaagggaagctgcagcaagtgggatggaaatgagacctgagtggggatcaccagcggacgatttggggaaggaggtgtaagaccttgaatgggatggacagggacagtgtaggcagagcgctgacaacctgctaagctccacggggccggcgggaggtggcaggttgggagggagggggaacggtgttcgcggcatctggagtcatcgatcttccttttccttcctaatttcgtgggcgctgagtttgcagacggaggaggtggggagggagctttgggatgagggggtgggggaagggaccagcgcgggtttggagggcggggcccgtggccgctacttgccactagcaaacacagccccctttagccagctgcccaccctcccccaacccctgcctccggctccctcctgcagccgaggctgctaattttatccgcccccgaccctggcctgggcgttaattggctgcggcttcattagcggttctccgctcagccgccccctccccttggggcccctggctggaggagggagggggggcggtgcggacaagctgaggcaccgagaaactcctcatcttcgccttgagtccggggtcagggtgcccactgggagggcagtgttccccaggggcttgcccactggctccagcctgaaactgagtcagacacggggtctgacccagacatatctgggagtgaaaagtcagtaagcagaaaataaatatctgctggctggctggctgaataaccgggtcaactgaaaagaggagggagatcaggaatggttctggatccgagattggccaaaagcagaagaacccggaagtctcctaacaccaggcttattgctggaaacacctgagaagagctgagcctagaatggcagggaaggagcttccggctaaggggagatttctaagggctggtatgagaaccaggtgggaacggctggaattaacaaattcgcccatctgggccttagtttccccacttgtaaagctacagtaaaatagtgtgtggtggggattctatgaggcttttcctgtgaacatgctgctgtgctggatagtcctcccctcttcctctgcctcctcctcttcttcctcatacagctggacatctgagagcagagttaggtgtgtcttcctgtcattgcacttgtcacactttgttacctgttcacctcttggtatcctagcagccagtgagctcttcatgtatctccagggctatggaatgcctggcatagagtaacattgctacataaggcaatgattcgcaaaaccactgcttaacaggctggtccaagtgcagtgatgtttacttgatcataatcagttacattatgataattgatcataatcagttacaggtttctttgtttcttcttcactcccactgcttcacttgactggcctttaaaaaacaatttttttggcctggcgtggtggttcacacctgtaatcccagaactttgggaggccaaggcaggcggatcacctgaggtcaggagttcaagatcagcctgaccaacatggtgaaaccccgtctctactaaaaaatataaaaattagctggacgtggtggtgggcgcctgtaatcccagctactcaggaggctgaggcagggagaattgtttgaacccagaggcagaggttgcagtgagtgaagatcatgccactgcactccagcctgggtgacagaatgagactccgtctcaaaaacaaaaaacaaaaaaaattttttttgaagacagtcttgctctcttgctcaggctggagtgcagtggcttgatcatggctcaccttgaactcccgggctcaagtgaccctcctgcctcaaccttcccagtagctgggactgcatgcacataccaccatgcctaggtaatttaaaatttttccttttgtagagatagggtctcactatgttgaccaggctggtttagaactcctggcctcaagagattctcctgccttggcctcccaaagtgctgggattacaggcatgagccaccatgcccagccaaaaatttttttttaattaaaaaaaaaaacttggcttatcagaatcactgaggagaggtttagttgtgtgacagcataagtgggcaaatgtctactctttgagatccattgaattagaacctctgaagacagaccccacactcatatttatatcatattttctaacccattctgatgctgaggtttgggaacctactcctggaggggttgatgaatcccattcccaagggtttcttccggatgaagtcaggctaaaaggaagatcccttccagtctcaaagatctatagccctggggaaaaaaggagagcccaccgactcctgggacatcaagaggtggacaggtaacaaaatgggacaagtgaacaacaggaggggtgccttcctctgctcccagatgtctgaggagaaagaggagatgccatgtaggaggcaggtctgtgggtcagaggaagaggggaggacaatctgtcacagcgcatgttcacaggaaaagcctcattgaatcctcaccacacagtattttcttgtggctttaccagggaggaaactgaagcccacacaagctaatgcactagtcccagagccggaacttgaattcaggtcttccgacccttctaaaccacggtgctttccagtgttccatagctctttatcttgtgtgggggtctagatctcctggagtctaataatgctagctagatattcagtaggcaccctataaacgtttgtcttgacaacaagcagagagaaaaccctgaaaagcttcaagatagtaaggagagggggcggcactggacctctgtttttgttttttgtttttttccccccaggcaagggcctctaaccctggggctacagacgggaatcataaagaaaaaagcggtgagtgggcgaactacaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcgggtaagaatggggctccaaacgctgggtaatcagtggaaaggaagctcttctcctaccttagttcctagtcacaaactctggggttctcttggcttttccatgcacgtggattggggcctcagggagcggacgtgtaactggggaatccccaagacccctgggcgcgcgtggagttaactgcgagcctgtcctcattctggcgatcagacgccccagggcctcgtgaccgcccatttcacgtggcattaggggagaggacagccccggatgccccgcggacccggtgctggcaaatgagcggagttttcggcctggtctcacaagctgagcctttccggccagctctgagccctgcagatgatgcaaccgagcttcactgcttgcatcaggcaggggtcccggcggcagtgagggctggaaggaggtggaacgggtagggggctaagtaaggggaaagggtattggcttactctcgggcagatccccacccccaccactcccacacagctcttcctcacggactgctaaaggtctcccctcccacctgcattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggaggtgggggtagtgagaactgaaacaggctggctggacaactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgagtatggatgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggttggtggggggggctggagactgggcacctccccagggggtggtgaggaggtgtgggaggagggcagccttgggcaggcctctccgggccctccccaggctgaggccttgcctctgtacctgcccaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccacggctgcttctgtttgatccctggggacagaggggagcaagggaggggagtggcagggggaggcccaggtgtggggctggagggggtactggcggcagcgggaggcagtaggcttgggcaggggaggagtgcgctgcgcctcaggaggcaaaggtgccccagcctgggcaggccctggaccagcccaagctgagcagcgccgcccctgggctggctctcagagcctgggctaacgtggagcccgccacgtcgcttggcactcagaggcccctgcttcttgttggctcacgtaggccacgctcaacacgtagcctgtgccacacccttcgaggcccgggtaggagggcagaggggctggtctgggctcttggtggacccctgctggtgctgcctgcctcctcctcccccacgtgggactcaagccaagggtcagaggcgcttccgctgctgggagcaagggaggagagtaggggtggagcagcctcccctctgcgtgggaacccggcctgtgtaagcagtagcgggacagggtggccggagtgatgccttggggcctgcggggaggagtggaagaagtggatgggctggctggctgtggcttgcatggcactggcagcccagcctggcttagaagtctggccggtccttcttcagcttcttatagtcagtggaaactgcaaggaactaagaggagagggaaagggggttgcgctgagtaccccaagcctccctttgcttctagtacgggagttgtgggtgccaggaccaggagataagaggatggggggcaaccctagagccatcgagaggtaccttgtattggtcattggggctcaggcggttccagggctccgggttgttctttctgtcccagctgtggagcaggaggggggagggttagggtctcctccctgggacccagaactctgtaacccaatttgacccccaagctccacccggaggctctggccccaccccagtacccctgcctcctgccctgggggtcccatttcccagatactgacaaaggaacggtcatattagcaggtgctgacaagtgagacaagaagcctgtcaccattgtcagcatggggctgcgtgacaaactgacaacggggcccagggactcccacttgctgcctgccaccctaggttaaccctaagagcagagtcgtgggaatcagacacagatcccaaggggctgggtttctggtgatgtgccgggaattataaagccatgggtgcgcctttcacttccggaccctctccgcggccgggtgtgaaatctccgccccacactggtccccaatgccacccccagcagctcacccggccacaaccccagtgctctggtgaggacttagaggtacccaaaagcccaagcccaccgctggctgagcggcgtcgtcatggcaacccggccgggagaggcgcgggttccgcatttcagggcgggccaagctgaggagtgagcggccaggtgggctggaggggatacgggggtctcccaggtcagcagtgggctccagccctgagatgccggtcggtacagtcgaaggtgcatgcagcagggcacgggatccccactagggccgcctatttccaccccatcttgcctcacccaggcccccgtgagcatcccaagccgtgcctttaccagacgtcggggctgcgaagggcgagtcgcagcaagtaaagcgcagcgctgcccatgcccaggcagattaagccgatcatcgggatgatctgcggggaagagggagagcacttttggggtcagccctctccccgcagttcccagtcaccctttacaagcttttctgcccaccccaaccccaccccgggtctggtgctccctccctggaatctcctacaaccatatttcctggcatggtctccctcaccctacagcgatcgtgtccaaggtagtagatttgtgggacacagggacgtttcggagagagactggggcaaccttaggggaagaataggagcgctgagggacctgggcacaaggcaaggcattgggggatttggagggtggggcagcaggagagttaggagttagaggttctgaggttctgaggactcacccccggatgtcttttgatctgccggtagaagcgggccccaagactggctcctgccatatcgttgttttcccagtctggtcctctgcagtggctctgtcctctccctcctcctggggtcccgcccctgagtggggagggatcagcccagcccagagcagcttagcttggcccagcccgtgcttctttggactcaccccaccccaacttagctcactttctcctcaattccaggcccaaagcctgtaggggaattgtctgggagccaagtggtttctgctctccgactctctcctccagatgtctgcacctggaccaagggacaccatcattcttggggcttctggcatctgagggaaggacctcagtggcataggaccccataagatgtgggaggaggcatggccatgggacaggcacttagcaaaatgcatgtgtggaatgttcacaggtgggaccaggaggggctaaggccagtgagggcatgtgcagcacttccctgacacccttagagctgtccaggagcgggtcctgagaaccctggttctgtcccctccacagtgtagtgggggaaggaggaagacaggcccacaccgtaaagctcccccagcccctcttgttctgagtggtttcttcaggttgtggttggactggaattgcggttggaggctggaagaaccaggtgtatgttaatcatggctcaggatagaatacgccagtttatttattctaccacagtcatggcagtgaggcttgagagacttgcttgctctgcctacctggggtagggtaaaggtggggccgcccaaggaggccatccacttcctctggctgtgggatggataggaagggaatggagtgggggaaacaggaaagatcggacagatgctgaaagagaacaagacacagacacagaaatgcaagcgattccctcctgtcctcaaccatctcaggtgtgtgctgtgctgctggggtggggaggctcacagcccccgtctctggggaatttgggtcttagggacgtaggaaccgagtcctaatatctctccccactcccacgataacctccaccaccccctccctcctcgcagccgatcctgcagagcacctccccctccagagcccgccctgtggagggcgcgggcgggagcgagctatgcacccgtctctgggatcgtcggggtacagggagggagagggcgctttctagggtccgcctccctttccttctcgctgatacttccgccgccccctactctgacaagcgcggctgtaattaggctgcggggtcccgggctctccgcctcactccggcggataatgagataaagtgtcagagacacggcgagaacaaagagacagagactcgctgcgatgtgtgtggggggggcgggggagcggggctgacgggctgttagagcctccagcagcccagccctcccgagagcccgcgcctccagggcccaggaagggagggcgtgtcctgtcacccgcgcaccccagccctccagtctctgggaccaaaaaacaatcccagagctcaaactcgagcggccgcacaactgggctgcacatctggttctctgtggcacagctggggagccaggacgccggaaggggcgcctggtccttgcgcctttgctcacaggccctcgcctgcttccttgtgccctttgttctgagttccggtgaccccggccaggtcccaaattctccgtcgcgctccttttccagagccgccgctgtccctccggccttgggcctccgccccgctcaccgagatgcaacgttacattattgcctccgctccgcctctccgccactctctgacccttctcctgcttctggtccctgtctctgtgaatttatttctaagcccccttccatctttggttcccgtctctggctcgtggcccatggggccgatctggaatacaggactccttgggttccggatcccatctctcctcgctccccacactttcccaccacgaggactcaggccacgctggcccagcggggtgagggaccgcaggagtcattagccgcagattaggcacggcccgggatcccgctgggactggactccaagcgctaacccgcaccaggatcccaatccgcgcgctggctgcacagagggtcaaaggcagcgggactcagcggatcgagcgtgttgcaggggccgtgggctcgggcgccccctggaggccgagcggcccccaagctcggggaagaggccttgggcaccccctgtcgggcagtgtcgaccctgcactcccggcgttcgggccgctaagttggtgcctggagtgtccgtccacgcccagcccgtcactccgccactcccgcctccaagacagtgggtcctgcagcctccactcttctggtgtgagatgggaccggagggcggagaggggacgcggaagctcctatctctccagccacaatcggcacccagggttcaggcgggttcctcttctggggttgggcatcctcagatgcctgggggccggggaggcgggggcttcatctctgcttctgggctgcagattcgagattgccctaagccctctgacccggcctgtcctagcctctggctgcccttctttctgcctcttgttctttctgccttctgtctgcttcctgtctctgggtatgtccatctctctcttccctattctggctgtgtctgtctgctctccctcttgctgccttccctacctggctttgtccctctgcatcggtttttctgtgtctctttgtgtctcgctccctccctccacatctctccatctcactgtgtctctctttactaatgcctctctttgtctctgtctttatctctgtctctccccaaccccactccccagctctattcctattctctgggttgctgcctctggggactgaagcagcccaacagggcagcccggagacgcctcggggcactgcccggggtcctcatcctggtcacctccacatgcccgtcaactccgcgcagcgttgatcttcccgctgcggctgtgggacgtggaggggcgcccggaaaggaagacacagggcccagcatctgctcgggagccccggggcccctgacccccctctgccattattaagggcgcctggtcccgaggcaccgagatgatcatgattgcatcagccagacagaagcggagccgggagctgcgcggtgagcgaacgagtgagacaaagccgcccgcgccatctgtttatgcaaagcgctctccgccggggaccccggcgtcccggctcctggccgggcttggggcaagggtcataagcccattcccacccggcgcccccaccgcgccttggcttcccctctcctcagcacccagagggccgctgggcgagcggaacggaaagggggcgggggtgttgatgtgattggagcggacgcggctgtttcttcaataatggatggagatgatgcggatggcgaagccgagctggccgggagaggagagaggaatagaaatggggaaaggaaggagtgggggcgggagactcaccccggcgcgcgcacacacacactcgcgcgcgcacgtgcgtcacactgtcattcggatacacgccgccgcgcggctcacacccaggcacacgcctacgcactgtcactgagacacacatacctgcaggcggagacgcgatggcaacacacactccccgctggctcttcctgattttcacacatacacagacctgcaggcggagacgcacggaaacgcccccacgcggaggcacacccgggcaaaatcacccagatgggagctggggacggggaagtggacaaacccgacagatatagacacactcaggggcacagacacacacccgggcacagagtcggacacacctggggctcaggtagacacacctcacatacccagggaacaaacggacacacactaaccacacgccggagatacagacgtccataattgccaggggcacggagagcccacccacacccactcagaggctagcacaccttagcatatgcaggagttgccatctgtgccctgcggggtggaatgtggcagggaggtcgtcagggtctccggagcaggccttgttagcctagcagtatgatgaggtcttggtgacaggaggcgcctggggctgtggactaggaggcccgtgcaccagggcttagctgtctgcaagcttccttgactggcccctagggcgggtagcgccgacgttgggctgcccctgagcagcagaccgggcggaccccactgacccaaatcgggcagtttcgtggagggagagcctaaagggaacactggagctgcaccgagagattctcaggatccccaacactgctgctggtggggtttatagaaagggtcactctgtactctgccttttccccccgtgctgcccagtcttccaacttcaaggggcacgtgtgtgtgtgtgtgcgcgcgcgcgcgcgctgagtagagtgggcagtggaggaggttggggtgccggttgtcttgtaccccagtaccggcccttcctcggatctgttttcaattcagtctgctccttggcccagacttatgacctttgcagcatgcggcagtatcatccatcacccaggcgccgtttagggggatggagggcgctgggagctcacatagggtcgctgtcacgcctgccgccctctctggggacctgctctccggcccgcgggccagggcttaagagtcttggtgagtaatgacgggagggtgtgaccgtggggctcgatcgggacactgggtcacatgtccccacccctggtaccctagcacccctccttctagttcagcacagcctgtttccccgcttttcccgccccccttctctcgggccctttgcttaatttcctattaactgctgataaatccaattaaaccgccgctctaattagggacagctgccggctcagtgaggctagggaggggggcgccccccgagtgttgggggagaacagccgctctccctgcttctcggcatccgcacaccagcattgccgcccaatgagccagtaaattggttttgccttagcattggcgggggtctctcgaggatctcggggggctctgattttgagtccctcagaccttgatgaatagagacgacccgagccctcgcggtccctcccctca

SEQ ID NO: 1676 - DNA, 41840 bp, Homo sapiens
ctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggagggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggcttggagagcgtcgtccggctgggctccgcggcgcccccactccaggtgcacgggcccggagcccagagccccacgccctgccccgttcctcctgggcgcacagacgcggcctctcgggggaccagtgcctgagcccctcgaccccctccgcttcgcacctgggccaggggcgtgtccggggcgtgccggtgtgaaagtcaccttcggtgcccccagctgggcgggagggggcgcgcggggcgcggccgggattggagcgccgcggagccccgccccccgcccgcggagtcagacccaactttctcccccgcccgcgccccgcccccagcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggaggatcttattttattttattccatgttcccatttctcggctctcgtttcctcacagactctcacccctccctgtctgaactcccctacaaggtcgcttcagccgtgcccccccaactcttcctttttatcttggctgtctacagtagtgggtgggggcgggactgcccaaagccaggggattcgccaggatcagagaagcacagacggcactttgtctgagatcagagatgggggtgacaccctggaacctctccttaccctgctgaacctcctcccctccccctgccccttacttctaccccctgcccctgtctggtagaagtcactggcctgaatcaccccagccaggttctgactgggtacaagacataggggtgctctggtctgctgggaggagatggcttggaggcatttggggtcataacatctgatggcatggggataggggggacctggatgactgggcttctggaaagaacagcggttgggtgagattagggaccagagttcaaatggcccacccttcagctttcccaggaaacctaacctccctcccccaatgccctctctcagattcaggccctgccctctccaagcccacttctggggcctcttctccctcccactgtaccctgggacccctccctccaccctctctcaggcccaccctccaggtgttagctgctggcttaagcctgtctgtgggagtcaatcattcttgctgcccccgccccctcacctgggctgagaggagggatggatgggagggggaatgaggggggcgataaatatgtatgacgagcgggtggtggcagcattaataacccgggatcgcagcgtggcggggacggggaccaggcggtggagattctagcccagcagcttggctctgctgttcctgtccccagtgacactgtgtgtgtacacatgggtgtgggcaaacagaggggggcacccatgcttcctggcctccttacctacccacagcacagcctgtgggccagtgtaggacacctccccagagaccactcagatacaattgacatgcatgtatgtcacccccatcggaacacagcaagaccacacttgttctatgactacggatacaccccctttagaaagagcttgacacttgggcagaggatgacaggggctcacacaggaaaggtgacacctccagacaaccacatatagctaccctcagaccgctatacacagccatatagccaacccagacacgtaaccacaccagtcacacagacaccactccacaaattgacacacacacccagccaatccaggcacatacacacagtcaccgatttacacaacagacatgcagccacgacaagcagccacacacacacaggctcctcagactcataaccatgggcatccagatacacacccacacagccaccacagccacacacacatgtaccggccacacacacacaaccatttggggctaacagagacaccagaaccccaggctgacacacatggtactgcctccccccatgggacctgtgcacagtcagggccacagcacgcggcggtggtggctagctcaggctgactgacacactctgacatgcagctcctctcttgcctgctcccctcgctggagcggcatctccatatttcttcctcttgcttcctgtctccttcactcctggccacccccactcacccctaccccagataattgatggcccgggcctggcccggccgctcctgcctctcgatccatcttgtcctcgagcccatgctgtctccaagatcggtggccacctgagacacatagaacgggtgggagcaggagggggctccttagcccccttggagcccaggaaaagaacggccaggcggcctccaccagagtggagcactggcgactgggagggatacccaggctttcctcctctgctcaactggttcccagcactcactccttgcaggccagttggggctgaggcccaggtgggggctctggtctctgaggtcctggagcctctttctttttctttttcttttcctttccttttttcttttcttttcttttttttctgagagggagtctcgctctgtcgcccaggctggagtgcaatggtgcgatctaggcttactgcaacctccacctaccaggttcaagtgattcttccacctcagcctccccaatagctgggactacaggcgcaccccagaacgcccgcctaattttagtagagattaggtttctccatgttggccaggctggtctcgaactgaactcctgacctcaggcaatctgcccacctcagccccccaaagtgctgggattacaggcgtgagtcaccgcgtgtgccgggcgggagcctctttcttgatgctggatgttaatgtggtcacagcctccctggctcagtttgctcagagtccagtccctccctggctcattactggaaccaaccaggtgccgggccaggaaagatgagccaggatccagagctccactccctactcaccttcacactggctttgggtttttggccctcattggagctctgtgggccacatcaggattcttgacgtcatttcacagatgtacaaactgaggcccagatccatgaagtgactgggccaagactacatagcttgaaagggctgcagttctcctccaaggcacgctccctgcccgctgcgggactgcgtgattccatttggtctcctagcggctgtggaaagggactggcgtcgatagggctctggcaggatggcgggggacaaccccagcgtctctctctcctctttcttcgtgcacaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggcccgggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaatacacgcctgtgtgagacctttgtagggaatggggaggtggcgtggggcttctatgtggtagagacctggccaaggccttctccctcagcggctcttggggaaaccaagacaaagactgacagagctagcaccttggaagtcaccaaagaccagatcaaagagagctgagggttaccctcggggtaggagccccgcctgaggttgggattctcctccctgaggtgggcgaagggaagctgcagcaagtgggatggaaatgagacctgagtggggatcaccagcggacgatttggggaaggaggtgtaagaccttgaatgggatggacagggacagtgtaggcagagcgctgacaacctgctaagctccacggggccggcgggaggtggcaggttgggagggagggggaacggtgttcgcggcatctggagtcatcgatcttccttttccttcctaatttcgtgggcgctgagtttgcagacggaggaggtggggagggagctttgggatgagggggtgggggaagggaccagcgcgggtttggagggcggggcccgtggccgctacttgccactagcaaacacagccccctttagccagctgcccaccctcccccaacccctgcctccggctccctcctgcagccgaggctgctaattttatccgcccccgaccctggcctgggcgttaattggctgcggcttcattagcggttctccgctcagccgccccctccccttggggcccctggctggaggagggagggggggcggtgcggacaagctgaggcaccgagaaactcctcatcttcgccttgagtccggggtcagggtgcccactgggagggcagtgttccccaggggcttgcccactggctccagcctgaaactgagtcagacacggggtctgacccagacatatctgggagtgaaaagtcagtaagcagaaaataaatatctgctggctggctggctgaataaccgggtcaactgaaaagaggagggagatcaggaatggttctggatccgagattggccaaaagcagaagaacccggaagtctcctaacaccaggcttattgctggaaacacctgagaagagctgagcctagaatggcagggaaggagcttccggctaaggggagatttctaagggctggtatgagaaccaggtgggaacggctggaattaacaaattcgcccatctgggccttagtttccccacttgtaaagctacagtaaaatagtgtgtggtggggattctatgaggcttttcctgtgaacatgctgctgtgctggatagtcctcccctcttcctctgcctcctcctcttcttcctcatacagctggacatctgagagcagagttaggtgtgtcttcctgtcattgcacttgtcacactttgttacctgttcacctcttggtatcctagcagccagtgagctcttcatgtatctccagggctatggaatgcctggcatagagtaacattgctacataaggcaatgattcgcaaaaccactgcttaacaggctggtccaagtgcagtgatgtttacttgatcataatcagttacattatgataattgatcataatcagttacaggtttctttgtttcttcttcactcccactgcttcacttgactggcctttaaaaaacaatttttttggcctggcgtggtggttcacacctgtaatcccagaactttgggaggccaaggcaggcggatcacctgaggtcaggagttcaagatcagcctgaccaacatggtgaaaccccgtctctactaaaaaatataaaaattagctggacgtggtggtgggcgcctgtaatcccagctactcaggaggctgaggcagggagaattgtttgaacccagaggcagaggttgcagtgagtgaagatcatgccactgcactccagcctgggtgacagaatgagactccgtctcaaaaacaaaaaacaaaaaaaattttttttgaagacagtcttgctctcttgctcaggctggagtgcagtggcttgatcatggctcaccttgaactcccgggctcaagtgaccctcctgcctcaaccttcccagtagctgggactgcatgcacataccaccatgcctaggtaatttaaaatttttccttttgtagagatagggtctcactatgttgaccaggctggtttagaactcctggcctcaagagattctcctgccttggcctcccaaagtgctgggattacaggcatgagccaccatgcccagccaaaaatttttttttaattaaaaaaaaaaacttggcttatcagaatcactgaggagaggtttagttgtgtgacagcataagtgggcaaatgtctactctttgagatccattgaattagaacctctgaagacagaccccacactcatatttatatcatattttctaacccattctgatgctgaggtttgggaacctactcctggaggggttgatgaatcccattcccaagggtttcttccggatgaagtcaggctaaaaggaagatcccttccagtctcaaagatctatagccctggggaaaaaaggagagcccaccgactcctgggacatcaagaggtggacaggtaacaaaatgggacaagtgaacaacaggaggggtgccttcctctgctcccagatgtctgaggagaaagaggagatgccatgtaggaggcaggtctgtgggtcagaggaagaggggaggacaatctgtcacagcgcatgttcacaggaaaagcctcattgaatcctcaccacacagtattttcttgtggctttaccagggaggaaactgaagcccacacaagctaatgcactagtcccagagccggaacttgaattcaggtcttccgacccttctaaaccacggtgctttccagtgttccatagctctttatcttgtgtgggggtctagatctcctggagtctaataatgctagctagatattcagtaggcaccctataaacgtttgtcttgacaacaagcagagagaaaaccctgaaaagcttcaagatagtaaggagagggggcggcactggacctctgtttttgttttttgtttttttccccccaggcaagggcctctaaccctggggctacagacgggaatcataaagaaaaaagcggtgagtgggcgaactacaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcgggtaagaatggggctccaaacgctgggtaatcagtggaaaggaagctcttctcctaccttagttcctagtcacaaactctggggttctcttggcttttccatgcacgtggattggggcctcagggagcggacgtgtaactggggaatccccaagacccctgggcgcgcgtggagttaactgcgagcctgtcctcattctggcgatcagacgccccagggcctcgtgaccgcccatttcacgtggcattaggggagaggacagccccggatgccccgcggacccggtgctggcaaatgagcggagttttcggcctggtctcacaagctgagcctttccggccagctctgagccctgcagatgatgcaaccgagcttcactgcttgcatcaggcaggggtcccggcggcagtgagggctggaaggaggtggaacgggtagggggctaagtaaggggaaagggtattggcttactctcgggcagatccccacccccaccactcccacacagctcttcctcacggactgctaaaggtctcccctcccacctgcattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggaggtgggggtagtgagaactgaaacaggctggctggacaactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgagtatggatgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggttggtggggggggctggagactgggcacctccccagggggtggtgaggaggtgtgggaggagggcagccttgggcaggcctctccgggccctccccaggctgaggccttgcctctgtacctgcccaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccacggctgcttctgtttgatccctggggacagaggggagcaagggaggggagtggcagggggaggcccaggtgtggggctggagggggtactggcggcagcgggaggcagtaggcttgggcaggggaggagtgcgctgcgcctcaggaggcaaaggtgccccagcctgggcaggccctggaccagcccaagctgagcagcgccgcccctgggctggctctcagagcctgggctaacgtggagcccgccacgtcgcttggcactcagaggcccctgcttcttgttggctcacgtaggccacgctcaacacgtagcctgtgccacacccttcgaggcccgggtaggagggcagaggggctggtctgggctcttggtggacccctgctggtgctgcctgcctcctcctcccccacgtgggactcaagccaagggtcagaggcgcttccgctgctgggagcaagggaggagagtaggggtggagcagcctcccctctgcgtgggaacccggcctgtgtaagcagtagcgggacagggtggccggagtgatgccttggggcctgcggggaggagtggaagaagtggatgggctggctggctgtggcttgcatggcactggcagcccagcctggcttagaagtctggccggtccttcttcagcttcttatagtcagtggaaactgcaaggaactaagaggagagggaaagggggttgcgctgagtaccccaagcctccctttgcttctagtacgggagttgtgggtgccaggaccaggagataagaggatggggggcaaccctagagccatcgagaggtaccttgtattggtcattggggctcaggcggttccagggctccgggttgttctttctgtcccagctgtggagcaggaggggggagggttagggtctcctccctgggacccagaactctgtaacccaatttgacccccaagctccacccggaggctctggccccaccccagtacccctgcctcctgccctgggggtcccatttcccagatactgacaaaggaacggtcatattagcaggtgctgacaagtgagacaagaagcctgtcaccattgtcagcatggggctgcgtgacaaactgacaacggggcccagggactcccacttgctgcctgccaccctaggttaaccctaagagcagagtcgtgggaatcagacacagatcccaaggggctgggtttctggtgatgtgccgggaattataaagccatgggtgcgcctttcacttccggaccctctccgcggccgggtgtgaaatctccgccccacactggtccccaatgccacccccagcagctcacccggccacaaccccagtgctctggtgaggacttagaggtacccaaaagcccaagcccaccgctggctgagcggcgtcgtcatggcaacccggccgggagaggcgcgggttccgcatttcagggcgggccaagctgaggagtgagcggccaggtgggctggaggggatacgggggtctcccaggtcagcagtgggctccagccctgagatgccggtcggtacagtcgaaggtgcatgcagcagggcacgggatccccactagggccgcctatttccaccccatcttgcctcacccaggcccccgtgagcatcccaagccgtgcctttaccagacgtcggggctgcgaagggcgagtcgcagcaagtaaagcgcagcgctgcccatgcccaggcagattaagccgatcatcgggatgatctgcggggaagagggagagcacttttggggtcagccctctccccgcagttcccagtcaccctttacaagcttttctgcccaccccaaccccaccccgggtctggtgctccctccctggaatctcctacaaccatatttcctggcatggtctccctcaccctacagcgatcgtgtccaaggtagtagatttgtgggacacagggacgtttcggagagagactggggcaaccttaggggaagaataggagcgctgagggacctgggcacaaggcaaggcattgggggatttggagggtggggcagcaggagagttaggagttagaggttctgaggttctgaggactcacccccggatgtcttttgatctgccggtagaagcgggccccaagactggctcctgccatatcgttgttttcccagtctggtcctctgcagtggctctgtcctctccctcctcctggggtcccgcccctgagtggggagggatcagcccagcccagagcagcttagcttggcccagcccgtgcttctttggactcaccccaccccaacttagctcactttctcctcaattccaggcccaaagcctgtaggggaattgtctgggagccaagtggtttctgctctccgactctctcctccagatgtctgcacctggaccaagggacaccatcattcttggggcttctggcatctgagggaaggacctcagtggcataggaccccataagatgtgggaggaggcatggccatgggacaggcacttagcaaaatgcatgtgtggaatgttcacaggtgggaccaggaggggctaaggccagtgagggcatgtgcagcacttccctgacacccttagagctgtccaggagcgggtcctgagaaccctggttctgtcccctccacagtgtagtgggggaaggaggaagacaggcccacaccgtaaagctcccccagcccctcttgttctgagtggtttcttcaggttgtggttggactggaattgcggttggaggctggaagaaccaggtgtatgttaatcatggctcaggatagaatacgccagtttatttattctaccacagtcatggcagtgaggcttgagagacttgcttgctctgcctacctggggtagggtaaaggtggggccgcccaaggaggccatccacttcctctggctgtgggatggataggaagggaatggagtgggggaaacaggaaagatcggacagatgctgaaagagaacaagacacagacacagaaatgcaagcgattccctcctgtcctcaaccatctcaggtgtgtgctgtgctgctggggtggggaggctcacagcccccgtctctggggaatttgggtcttagggacgtaggaaccgagtcctaatatctctccccactcccacgataacctccaccaccccctccctcctcgcagccgatcctgcagagcacctccccctccagagcccgccctgtggagggcgcgggcgggagcgagctatgcacccgtctctgggatcgtcggggtacagggagggagagggcgctttctagggtccgcctccctttccttctcgctgatacttccgccgccccctactctgacaagcgcggctgtaattaggctgcggggtcccgggctctccgcctcactccggcggataatgagataaagtgtcagagacacggcgagaacaaagagacagagactcgctgcgatgtgtgtggggggggcgggggagcggggctgacgggctgttagagcctccagcagcccagccctcccgagagcccgcgcctccagggcccaggaagggagggcgtgtcctgtcacccgcgcaccccagccctccagtctctgggaccaaaaaacaatcccagagctcaaactcgagcggccgcacaactgggctgcacatctggttctctgtggcacagctggggagccaggacgccggaaggggcgcctggtccttgcgcctttgctcacaggccctcgcctgcttccttgtgccctttgttctgagttccggtgaccccggccaggtcccaaattctccgtcgcgctccttttccagagccgccgctgtccctccggccttgggcctccgccccgctcaccgagatgcaacgttacattattgcctccgctccgcctctccgccactctctgacccttctcctgcttctggtccctgtctctgtgaatttatttctaagcccccttccatctttggttcccgtctctggctcgtggcccatggggccgatctggaatacaggactccttgggttccggatcccatctctcctcgctccccacactttcccaccacgaggactcaggccacgctggcccagcggggtgagggaccgcaggagtcattagccgcagattaggcacggcccgggatcccgctgggactggactccaagcgctaacccgcaccaggatcccaatccgcgcgctggctgcacagagggtcaaaggcagcgggactcagcggatcgagcgtgttgcaggggccgtgggctcgggcgccccctggaggccgagcggcccccaagctcggggaagaggccttgggcaccccctgtcgggcagtgtcgaccctgcactcccggcgttcgggccgctaagttggtgcctggagtgtccgtccacgcccagcccgtcactccgccactcccgcctccaagacagtgggtcctgcagcctccactcttctggtgtgagatgggaccggagggcggagaggggacgcggaagctcctatctctccagccacaatcggcacccagggttcaggcgggttcctcttctggggttgggcatcctcagatgcctgggggccggggaggcgggggcttcatctctgcttctgggctgcagattcgagattgccctaagccctctgacccggcctgtcctagcctctggctgcccttctttctgcctcttgttctttctgccttctgtctgcttcctgtctctgggtatgtccatctctctcttccctattctggctgtgtctgtctgctctccctcttgctgccttccctacctggctttgtccctctgcatcggtttttctgtgtctctttgtgtctcgctccctccctccacatctctccatctcactgtgtctctctttactaatgcctctctttgtctctgtctttatctctgtctctccccaaccccactccccagctctattcctattctctgggttgctgcctctggggactgaagcagcccaacagggcagcccggagacgcctcggggcactgcccggggtcctcatcctggtcacctccacatgcccgtcaactccgcgcagcgttgatcttcccgctgcggctgtgggacgtggaggggcgcccggaaaggaagacacagggcccagcatctgctcgggagccccggggcccctgacccccctctgccattattaagggcgcctggtcccgaggcaccgagatgatcatgattgcatcagccagacagaagcggagccgggagctgcgcggtgagcgaacgagtgagacaaagccgcccgcgccatctgtttatgcaaagcgctctccgccggggaccccggcgtcccggctcctggccgggcttggggcaagggtcataagcccattcccacccggcgcccccaccgcgccttggcttcccctctcctcagcacccagagggccgctgggcgagcggaacggaaagggggcgggggtgttgatgtgattggagcggacgcggctgtttcttcaataatggatggagatgatgcggatggcgaagccgagctggccgggagaggagagaggaatagaaatggggaaaggaaggagtgggggcgggagactcaccccggcgcgcgcacacacacactcgcgcgcgcacgtgcgtcacactgtcattcggatacacgccgccgcgcggctcacacccaggcacacgcctacgcactgtcactgagacacacatacctgcaggcggagacgcgatggcaacacacactccccgctggctcttcctgattttcacacatacacagacctgcaggcggagacgcacggaaacgcccccacgcggaggcacacccgggcaaaatcacccagatgggagctggggacggggaagtggacaaacccgacagatatagacacactcaggggcacagacacacacccgggcacagagtcggacacacctggggctcaggtagacacacctcacatacccagggaacaaacggacacacactaaccacacgccggagatacagacgtccataattgccaggggcacggagagcccacccacacccactcagaggctagcacaccttagcatatgcaggagttgccatctgtgccctgcggggtggaatgtggcagggaggtcgtcagggtctccggagcaggccttgttagcctagcagtatgatgaggtcttggtgacaggaggcgcctggggctgtggactaggaggcccgtgcaccagggcttagctgtctgcaagcttccttgactggcccctagggcgggtagcgccgacgttgggctgcccctgagcagcagaccgggcggaccccactgacccaaatcgggcagtttcgtggagggagagcctaaagggaacactggagctgcaccgagagattctcaggatccccaacactgctgctggtggggtttatagaaagggtcactctgtactctgccttttccccccgtgctgcccagtcttccaacttcaaggggcacgtgtgtgtgtgtgtgcgcgcgcgcgcgcgctgagtagagtgggcagtggaggaggttggggtgccggttgtcttgtaccccagtaccggcccttcctcggatctgttttcaattcagtctgctccttggcccagacttatgacctttgcagcatgcggcagtatcatccatcacccaggcgccgtttagggggatggagggcgctgggagctcacatagggtcgctgtcacgcctgccgccctctctggggacctgctctccggcccgcgggccagggcttaagagtcttggtgagtaatgacgggagggtgtgaccgtggggctcgatcgggacactgggtcacatgtccccacccctggtaccctagcacccctccttctagttcagcacagcctgtttccccgcttttcccgccccccttctctcgggccctttgcttaatttcctattaactgctgataaatccaattaaaccgccgctctaattagggacagctgccggctcagtgaggctagggaggggggcgccccccgagtgttgggggagaacagccgctctccctgcttctcggcatccgcacaccagcattgccgcccaatgagccagtaaattggttttgccttagcattggcgggggtctctcgaggatctcggggggctctgattttgagtccctcagaccttgatgaatagagacgacccgagccctcgcggtccctcccctca

SEQ ID NO: 1677 - DNA, 1781 bp, Homo sapiens
tttttgcaatttggcattatggaactcaactttaaatgcctaacctctaactcagccattctatttctaagaattaattctgcgcagtcccccgttttgggaacatttcccacgcctgttctccattctcctgtagaaggggaacagggagcgggaaggaggggaacagggaaggggagggaggggaacagggaggggggacaggagggaggagaacaggcagtgggggcgggaggggagcgggggggaaggcatgggagggggcggaagggagggggcagggagggagagaggtgatgggaaggggaaaaggagggaggaggacggagagaggggaaaggagggaggggagcagagaagaagcggggcggggaaggggcggggaaggggcgtggaagggagtggggcaaggaatcaacactgagccccgtggcccgctcccgggtcagcgcgcctctctgctctcaccggggcgggtccgctgttggccccacccactcccagcccacccggccccgcaatggcccggcccagccgcccacccccccgacaggccccgccccattccccgccccccgtctgttcgtcacgcccggctctgccgctccgtcccgcaggccccgccctcatcccgcctcccggcccggcgcgcagtgcggctgcgcgggcgtctcaggctctgaggcccgggcgccgcggctcttttgtttctccgttggggccgagcccgggccctagttggagccggagtcggagtcggagtcggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgaggtgaggcccccgtccggcccgggatcccccgcccaggatcccctgcccctgcatccccgccccgagattccccgcctgtcccgggacccccccacgcctcccgagagccccactcgactttccaggccgacccccaccccaggatccccaccccgcgacccccagcccgactttccagttcagactcccgccccgagatccgctgccgggctttccagcccagatcctcactccgagacccccagcccgactttcctgtccaaaccctcaccccgggacaccccgcaacctggtcccacagccggctttcgaggctggatccctaccccaggacccccagcgcgatcctcaacctggctccccactcggccttccagtcccgggattcccaaccgggatcatctcagggccccacctgtgtggactggggtctgggggaggcctgcgaggggcagccctggccttgaaggtgcacgtttggctttcagaagcacgatttggaggtcgccgtcaagtgcattaacaagaagaacctcgccaagtctcagacgctgctggggaaggaaatcaaaatcctgaaggtgagccagtgctgggggagggggcgtgggcgtgggcgtgggcaagcccccctcccc

SEQ ID NO: 1678 - DNA, 13995 bp, Homo sapiens
ttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggctcactaagacagtctaccctgtagttccgtttgcacccaagatctttgggaagccaaagaaggggtgggtcgttggtgaaatgtaaggggtggggacgaagtatatggctgaacccttggggcaggccagaatgatttttcctggtgctggtctgccctgcaaacagaccaaagagactaattttcgtatcaaccagagatctctgcaatagggaaaagaacactgtatttcctggtcaatccaccaggatcccaggtgcctcctcctggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttccttccctgttatctttgggatcagcaactggccagggttgggaagaggagggaagaggaggctgtactccagggccacctgccctgccaggtctctgtactcttgtctgctggatagatattgaacacttcccaggatataaagcagtttcacctcttttagcagttctgattggtggaaggtgccgggaaccatgcgttcacaaggatttggggagctcagcaggcataagtcctgtgattgattagtgatgccggtcacaggcatggaatttgaagtagagacacgtgtactggttatttgtcatcttccaattttcttttttcttctttttttttttttttttttttttttgagacggagtctcactctgttgcccatgctggagtgcagtggcgggatcttacctcactgcaacctccgcctgctgggttcaagaaattctcctgcctcagcctttggagtagcgtggattacaggcacatgccagcatgcctgggtaacttttatatttttagtagagatggggtttcaccctgttggccaggctgttattgaagtcctgaccttgtgatccgcccacctcggcctcccaaagtgctgggattacaggcatgagccactgtgcccggccatcttcaaattttctatgagccatttttttttttttttttgagatggaatctcactttgtcacccaggctggagtgcagtggcatgatctcggctcactgcaacatccacttccctggtttaagcgattctcctgcctcagcctcctgagcagctgggattacaggtgcccaccaccacaccagctaattttttttgtatttttagtacagacagtgtttcacaatgttggacaggtaggtcttgaactcctgacctcaagtgatccacctgcctcggcctcccaaagtattgggattacaggcgtgagcactgctcctggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacatcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacggagggtagcccctggaggtgcagggaggttatggacttaatgcttaagattaggcattatataagccagggcatgaaaggatccatctctctggtgctggatggagggtgagcccgagggggcagaatggacaatgagggggccagcaactatcgggaaggttgtggtgtctgggaatgttggaggccatggggacagagggaaggggatggaggggagacatgcttcggaggggatgtcctaggccttgctgattgatggctggtgtgggaacctccgcagcacaagggctcctttatcatcaccagcagcaaccatgccaaggtaaaaaggtcagggcatggagagagctatcggttaaaaagtggcaggagagacagcaactggctgcaagactcagaacttcttggctgggcacggtggctcacgcctgtaatcccagcactctgggaggccgaggcggggggatcatggggtcaggagatcgagaccatcctggttaacacagtgaaaccccgtctctactaaaaatacaaaaaaattagccaggcatggtggcgggcacctgtagtcccagctactcaggaggctgaggcaggagaatggcgtgaacccgggaggcggagcttgcagtgagccaagatagcgccactgcactccagcctgggcaacagagcgagactccgtctcaaaaaaaaaaaaaaaaaaaaacttctttggatcctgatccaaacaaactgccaagaaaatgtttaggagataatcatagagttttgaacaggagccacatattagatgaaatccaggaattattgttaattttatgaggtatcttaatggtatcgtagtgatgctacgctctatcctagcccaggctggagtgcagtggcgcaatcagagttcactgcagttctgaacttcctggcctcaagcgatcctcccgtgtcagcctctggaagtgctcggattataggcatgagccaccacacccagcctgttgctttttttttgtttgttttaagaactcttatctctgaaaagtatgttcctaaacatttattgatttatttacttatttatttttatttttgagatgggatctcactctgttgcccacgctgaagtgcaacgacgcagtcttggctcactgcatcctctgcctcctggctcaagcagtctttccgcctcagcctcccgagtagctgggactacaggtgcagaccaccatgctggctaatttttgtattttttgtagagatggggttttgccatgttgtctaggctaggctggtcttgaacacgtgagctcaggccatcccctcacttcagcctctcaaagtgctagaattacaggcatgagctggcttctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgcttgcactgaacctcccaggagaagcagagacagatggtgcaagggccccagggaagacttacctttcacttaagataaatttcccatctttgaggctgggcagcttcctgagggggttgatgtcaatgtatcctttgctgtggtggtgacctgggaggggcagggaaggtctgaggctgtgggactccaggggagagagaactgagactcccagagacccaaacgcctccctctctattttctcaagaagagggaactgaggcccggagggacattgcgtctcaccccaggtcacagggcaaggcagttgcagaaccggactgcgatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagcttttggagtccctctgtgctggggatggagttggagcccacccctctgaccctcactcagggttagtggagccctgagcctttctgaacactggggaggatgggtgtagacggactgtgcacttctgccccctttgccaacctggtgggcaggtgctgagttcacaaggtcctagaatcccacaaggaagccagggtgcctggtgggagcccagggagtcccagctactgttccttcccccttctcctcgaaaagcctgttcatctgtggcgtggggactgtcattagtgagcactgactaaggtaggctggacaaggatgcagcctacaagccgcgtggcatcttttccttccctgtggacctctggggtgattcccttgtctctgtctctgctcctcagaaacgcccctatcaggctgtgcgcggtggctcacgcctgtaatcccagcactctggaggctgaggtgggcagatcacttgaggtcaggagtttgagaccagcctggccaacatggtgaaacccctgttaaaaatacaaaaaattagctgggcgtggtggcatgcacctctaatcccagctactcgggaggctgaggcaggagacgcacttgaacccagcagaggttgcagtgagccgagatagcaccaccgtactccatgctgggcaacagagcgagactccatcaaaaaacaagaaaaaaagaaaagccgcaatctgtgtgtcctgcctccccccaggaccaggcctgccaggcagcagtgggagttgacctttcagcagatccacaaactgaaagttgaactggatgtcatgcttcttcgagaagatgtagacggcacggcagggtgctgacagcaggtccatgtagagctccagtgccatgttgagacacatgccaggccccacagccgcagttggccagccacagacctgggcctatgtctggccagagtccctggccctgtgccctctccgatctgggcccaggatcctgtgttccccagggaaacctcttgtttccctttgtgttgtcataaggccaggaagcctgcaattctcacagcatcaaggattctaaggaggcccaggagtaggctggggagaggcccgtggcaaaggtgtggcagccgtgaccctactctcccccttccacgtgtgcctgtgccccgtggtgccacctcacagacaccagtctgagaagggattatgcctgggaattcccacggctggattttcattgcagaacctgacgaaaggggctttgcagggtccagaatgaagaggaggcaatgagaattatccctggaggattctagaagtagaggctgggagtatccacaggtaaatcgagcctgaactatgactagaaaggaattgggagaaagagacacaggtgaatcgagcctgaactatgactagaaaggaactgggagaaagagacacaggaaactgtgagctttgggagcaatggggacaccaccaccaggaagtcagggggcactcagccggtgtgtgccacacagaggagcctagaaacttcctggccttggttggggctgcagtggccagactgtgtacctggtggccaaggaaggtaactagagccccacgtagaggactgagtgccactcactctatgctgtgatctaataggtctaggctgagaaatgggactgaccccacttctggtgacagagtaagcctggagacaagcgaagagcatgcagtgtgtttattgcagacagcagggtgcagtggagtgggctgcacccactgcacctgcttctgggccagctgggggtcccgccaagcctcactgtggttcagaggctggagtatgagcttgtgggcctccagcaagagctcagtaccaagggcagccgccacacgggcctgccacactgccagccggggcagtcttggaagaggtcgcagccaacggcagtgggctgggaagacagggcagctggggttggggctcagccccatgcccagagtccccccagagggcaggtgggtaggaaagcttcacctgcatcacctccgtcagcaccaagtcttccagggagatctgctccattgccaggaagggcctggccaccagcaccccccaatccaggtgctgcagggctggcatcagcctccccaacagccgctccagctgtgcagcatctgcaggctgtccggagaagtggggcaggagagactgggctgggaggagaggagcaacttaacccagactcttggaagcctcttgggcctcctctccatcccttcccggctgccactcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtgccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatccgggtgacctacgtcctttccccacctgggcagctccagctggctcagactctagccaggttccagcctccagctttagcccaaaggtgcccctgggtccagcctctgcatcggagctacacaggctgaaatgaggaaggggcctcagtgatttggaaagatctccaagccaaggaaagatctcccctctcgcctctgcctccccctacaactctgagccccagaacccaggcagatcctggctctgaccctgggtgggcaccaggtcaccattacctctttgctagtaggaagtcgccatctctgagggcaggcaccttccccagggggttcaccttcaggaactcaggcttcaggtgctcccttggtgggcagaaaggcgagaaggctcagtgtagggcctggtccttggcacccactccatggggcccagcccagccacctggctcaccccaagccaactccaccatccacagctcaaaagggatgtcattctgtcttgcaaaagtggatagtgtgtcaggtccaggaagagctcaagccccattgctgctcctctcacctgccctccccagaattctggacctccaggagttgctcagcccttctccactagttctgagctgtttcctgtccatagtctgctgtagtgggccagagcacagggcagatttgtcttcagggactttctctgggcattcctgggcagagaacttcatcttctctgttaactcttgctgataattctctgtagctaggcaccttgtaaaacccatgtcccagaatgccaaacctggaaatgcaatgtcagcgccgaaactgcattgaaactgaatgaa

SEQ ID NO: 1679 - DNA, 1581 bp, Homo sapiens
actctcctaatcttgcttccattgttatctgagacggcttcatacctttttttggataatatgttatattatccaaagcaaggtatgaagccggaaatagactctgttagtggaatgagctgcaaagtcacattgctgtgggcagggatacagagaagaatggacacttatggctacttttaccacctacccacagacgcgtgatctgaggtcgtaaacactggactgtgagagattgcacttgaggcaatggggtgtgcctcaactagacgtctagctcacatcccatcctacctccaccctgaggctggggccgcatcttaccatgtgtctttttattgcaggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggtgagctggggtctgttgtgctctatgggcagagtgctccgggctaagaagggattggctgggacctgcagtgtaatcacgttgcatttaaaatgcaaatgatgttccttgtctcagggttgttgcaggagtaagaaccaagcaggtgagtataaaactcttaccacagtaagtggtgaacagtgaatgtccaacaaatggaaacacttgtgaagtggcctcattgtctggggtaacacccgaggttcattgtcccagggccgtggagatccaaggacgcagagatccaaggacgcagatacacaaagagtgaggttaagagcagaagtttaataggcaaaagaaagaagagctgtctgctacagagaggggtctcggaaaaatggattgcccgatccatggtgaaatgcagagggttttatagacgagctggtgggaggtgtggtgtctgatctacatagggcatgaaaaactggttaggaccaggtgtgccgtttgcatagggtgtgaatttctggcagcccccaccccagtcttttattaagcaggcaggttctctgcctgagctgcactatgttgcccatttctttcttactgtacccatgctaataaaaaagggaagatggtgcttccatggtgaacaggcctggcccccaggtagctcttttcactggcgcagctgctggcattccccccatgcaatcttcgcgctcccttatttatgtttgcagctcagtttttcaggatgctctttgttagaaaagaaatgatttcttgggctggtttttgttagaagggaagctctgctgaggacttttgccctcactatctgcctaaataattttttacctcctatatcacttattattataatacaaattatgatacatgtttatattttaaatatttatgtgtaaatacaagttatatgtatattcataagtataacatttataaatagaaacttatataaacataatttatattttaatttgttatatttataattacatataatcccacaaacattattttactagataactatagagtccttaacattttt

SEQ ID NO: 1680 - DNA, 4308 bp, Homo sapiens
ctaagtagtaatgacgtgcagattctctttgcattaggattgcagattctagttggaaaataggttgcatccaagagatgcaactgacaaactttggggagagaagtgatgaagagctcgccattccatttgtggagactttgcattttctgggggtggtatcccacctatggttccctgggtttatgaggtggggcaggctcactgcttcctgattactggatcccagcagaagcagcatgctgctgaagtccaggtcactgggggccattgttatatatatttcacttctccaggccctctacctgactttagaagtgcccacccacatatattcagtttctggaggggtttgatcttaaaactggatccgaagtgatacagtctgagatattgaaaacatagaaattggccgggcgtggtggctcacgcctgtaatcccagcactttggaaggccaaggcgggcagatcatgaggtcaggagatcgagaccatcctggctaacactgtgaaacccatctctactaaaaatacaaaaaaaattagccaggcacggtggcgggcatctgtagtcccagctactcaggaggctgaggcaggagaatagcgagaacccgggaggaagaggttgcagtaagccgagatcgcgccactgcactccagcctgggcaactagaacgaggctccgtctcaaaaaaaaaaaaaaaaaaagaaaacatagaaattaaggatttccagatttccaaacactttaaaaatgaggccaggcatgatggctcatgcctgtaatcctagcacattgggaggccgaggtgggaggattccttgagcaccagaattcaaaaccagcccgggaaagatgacaagacctcatctctacagaaaacagttacctggccatggtaatacatgcctgtagagccagctactcaggaggctgaggtgggagaaccgatcaagcctggaagaccgaagccgcagtgagccgtaatcaccccactgcactccaggctgggggacagagcaagaccctgtctcaaaaaaagaaagaaagaagaaaaagaaaatcgcctaccgtaggtgttttaggttacagtttggattctctaatgcctgacagagaatccacaatccacgagctatctggttgatactcaagtccaggtttgtgaggctgcaggcttcttggagcgcctctgagagatatctacagccaagcttggttatgctgcattgctgtaacctacaggataatcaaaggaagagaagcctgttatccctctggctaacgccctgtgaagcagttatttccaacactatataccttccacttatatactggaatgcagtgctgcactcttggctcactgcaacctctgcctcccaggttcaagcgattcttctgcctcagcctcccaagtagctgggattataggtgcccgccacctatataaccagacttggtggtgcacgcctgtagtgccagctactcagaagactgaggcaggagaatcgcttgaatccgggaggcagaggctgcagtgagctgagatcgcgccactgcactccagcccgggcgacagagcgagactccgtctcaagaaaacaacaacaacaacaaaaagtatttatataaaacataggtggcaggtaggaattgacccatgaactggagctatatacttccaggtgggcttgcacataaaagcatgcaaatgggccgggcacagtggctcacgcctataatcacagcagtgggaggccaagacgggcagatcatttgaggtcaggagttcaagaccagcctggccaacatggtgaaaccccatctctactaaaaaatacaaaaatcgggccgggcgcggtggctcaaacctgtaatctcagcactttgggagaccaaggtgggtgaatcacaagatcaggagttcaagaccagcctggccaaagtggtgaaaccccatctttactaaatacaaaaattagctgggcacgatggctcacacctgtaatctcagcactttgggaggctgaggcagacagatcacctgaggtcgggagttcaagaccagcctaagcaatatggagaaacccgtctctactaaaaatacaaaattagccaggtgtggtggcacatgcctgtaatcccagctactcaggaggctgaggcaggagaatctcttgaactggggagacggaggttgtggtgagcagagattgcaccattgcactccagcctgggcaagagcgaaactccatctcaaaaaaaaaaaaaaattagccaggtgtggcggcccatgcctgtaatcctagctactcaggaggctgaggtaggagaattacttgaacccaggaagcggaggttgcagtgagccaagatcgcaccactgcactccagcctggtgacagagagagactgttaaaaaaaaaaaaaaaacatccaaatggccttctgattccatccatttccagctctgcctgggacaacagcttaggctctgggttcagaccgacccaggacaggatctgagccctgggtcacttattttctgcgtggttagattatggaaatttcactttccctgtcattttatttcatgtttaagttttgtctttaactgacacattctacatatataggggtatagtgtgatgttttggtgcaggtacacttcgtataacgatcaggtaggtgactgtttgtttaacaatagttattctaagccaggcacagtggctcatgcctggaacgccagcactttgggaggccgaggcaggcagatcacttaaggccaggagttcaagaccagcctggccaacatggtgaaacctcatctccactaaaagtgcaaaaattagccaggcatggtggagggcacctgtaatcccagctacttgggaggctgaggcaggagaatcgcttgaacctgggaggcagaagttgcagtcagccaagattacaccactgcattccagtctgggcgacagagtgagacttcatccaaaaaaaaaaaaatgaatctcagaaatgaccactagctagaatttctgaacaggaacaggtcttcaaccctatgcaatctcttgaatatttttctaaccataattttaatgtgaacaggtagctcacgctgggcttctttccatataacaagattcagccaactatagttcgtgggtcaattccaacctgccacctatgtcttttacaaataaggatttttgttgagtttttttttgtttttttcttgagacggagtctcactctgtcgcccgggctggagtgcagtggcgccatctcagctcactgcagcctctgcctcccagattcaagcgattctcctacctcagccttctgagtagctggtactataggcacgcaccaccaagcctggttaatttttgtattttttagtagcgatgggttttcaccatgttggccaggctggtctcgaaccttaggtgatctgcccaccattcaccacctgttccccaataacctatggaaataaaagtttaaaaaaaggtgccactggccctaccacataactcaatctacctccaatagcaggcagtactatgtcataggaatttgaaagaacacacacaaagcatcagatccgagaaccaactactcatctcaaatcttccttcatagcaggaagaggctctgctgacatgcaaatattaacatgtttctacctgtatctgcctggttttttttgtttctttgtttttttgagaaggagtcttgttctgtcgcccaggctggagtgcagtggtgcgatctcggctcactgcaacctccgccttccaggttcacgccattctcctgtctcatcctcccaagtagctgggactacaggcatccgccaccacacctggctaatttttggtatttttagtacagacagggtttcaccatgttaaccaggatggtctccatctcctgacctcatgatccacccgcctcggcctcccaaagtgctgggattacaggcatgagccaccacgcctggcctctgcctgttctttaattcttaccaggtttttaaaagttacatttgaaatgaattaacaagtactttcatgtctctcctgcttgaattcatgtgcacacacacacacacccagcagggacttacaccaaggtctgcagtttacaatcagggtaactcaagccctcacacagaaacttcacccctgtatccccaatggggttcttggccaagcacaggtgtgtcagcttcttgctgacaaccaagacagcagcaaggtccttgcaactggcttctgtaagacgacag

SEQ ID NO: 1681 - DNA, 2543 bp, Homo sapiens
gaagtaatgcgcgacaagaatttaaactcttaaaacgattagcagcaaaggtctcatgtgcttttttttaattatcattttttaatcgaggtataatttatgcatttaaaaaatcagatcaattgccccccgggctctgggatggaaggcggtgtgcgcctgcgaaggtcagaggcccagcggcgccagggctcctcggcggagagccgcccgggtccggcgctttgctttcgccttctgccccaccgcgggcgaagccccagggccccggggagactccaggccggctgggccggggtgcgcccgccggctgtccgcgctcgggcagggtggggcgcagcgggcgtctgtcctgctagcggggatcgggcggctggacccaagagcagggcacgtgcgcagcgacgcggggcggccccgccaggagccccgacccgggcgcggcgcagggcccggcggagagcgcgcattcccgagcgccgcgagccggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagatggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgta

SEQ ID NO: 1682 - DNA, 12390 bp, Homo sapiens
acacagttgtaacttagaatatgcttataatatttttaaaaatgttatagcatccttttaaagagtttatgaataatttgtgctggttttcaaggggaatgcttccagcttttgctcattcagtatgatattggctgtgggtttgtcacaaataggtcttattattttgagatatgtctcatcaatacctagtttattgagaatttttagcatgaagagatgttgaattttatcgaaagacttttctgcatctattgagataatcatgtggtttttctcactggttctgtttatgtgatggattacatttattgatttgcatatgttgaacgggccttgcatcccagggatgaagccaacttgatcatggtggataagctttttgatgtgctgctggattcggtttgccagtcttttattgaggattttgcattgatgttcctcagtgataatgacctgaaattttctttttttgttgtgtctctgccagattttggtatcaggatgatgctggcctcataaaatgagttacggaggattccctcttttctatcatttggaatagtttcagaaggaatggtaccagatcctctttgtacctctagtagaattcggctatgaatccctctggtccttttcttggttgctaggctattaattattgcctcaatttcagagcctgttattggtctattcaggaattcaacttcttcctggtttagtcttgggagggtgtatgtgtccaggaatttatccatttcttctagattttctagtttatttgcgtagaggtgtttataacactctctgacggtagtttggatttctgtgggatcagtgctgatctcccttttatcattttttattgtgtctatttgattcttctctcttttcttctttattagtcaggctagtggtctatctattttgttgatcttttccaaaacaccagctcctggattcattgattttttttgaagggttttttgtgtctcttgtcgccttcagttctgctctgatcttagttatttcttgtcttctgctagcttttgaatttgtttgccattgcttctctagttcttctaattgtgatgttagggtgtcgattttagatctttcccccttcctcctgtgggcatttggtgaaacactgctttagctgtgtcccagagattctggtatattgtgtctttgttctctttggtttcaaagaactaatttatttctgccttaattgtgttatttacccagtagtcattcaggagcaggttgttcagtttccatgtagttgtgcggtttgtagttagtttctcaatgctgacttctaatttgattccactgtggtctgaggggctgtttgttatgatttccattcttttgagtttgctgaggagtgttttacttccaattatgtggtcaattttagaataagtgcgatgtggtgctgagaagaatgtatattctgttgatttggggtggagagttctgtagatgtctattaggtccgcttggtccagagctgagttcaactcttgaatatccctttttttttttctgaatatcctttttaattttcagtctcgttgatctaatattgacagtgaggtgttaaagtctcccactgttattgtgtggaaatctaagtctctttgtaggtctctaagaacttgctttacgaatctgggtgctcctgtattgggtgcatatatatttaggacagttagctcttcttgctgcattgatccctttatcattatgtaatgccttgtttttttttttatctttgttggtttaaaatctgttttatcagtgatgaaaattgcaactcctgcttttttttttctttccatttgcttggtaaatcatcctccatccctttatttcaaacttatgtgtgtcttgcatgtgagatgggtctcctgaatacagcacactgataggtcttgcctctttatccaatttgccagtctgtgtcttttaattggggcatttagcctgtttacatttaagattaatattgttatgtgtgaattgatcctgtcattacgatgttagctggttattttgcccattagttgacgcagtttcttcatagcatcaatggtctttataatttggtatgcttttgtagtggttggtactggttgttcctttccatatttagtgctttcttcaggagctcttgtaaggcaggcctggtggtgacaaaatctctcagcatttgcttgtctgtaaaggattttctccttcgcttttgaagcttagtttggctagatatgaaattctgggttgaaaattattttctttattaatgaatataggcccccactctcttctggcttgcagggtgtctgagagagatccgctggtaagactaacagggatgggcttccctttgtgggtaacccgacctctctggctgcccttaatatattttccttcatttcagccttggtaaatctgacgattacatgtcttggggttgctcttctcggggagcatgtttgtggtgatctctgtatttcctgaattggaatgctggcctgtcttgataggttggggaagttctcctaggtaatatcctgaagagttttttccaatttggtccattctccctgtcactttcaggtacatcaatcaaacgtaggttcactcttttcacatagtcccatatttcttggaggctttgctcattcccttttgttttttttttttctctaatcttgtcttcttgctttatttcattaagttgatcttcaatctctgatatcctttcttctgattcatcgattcggctattgatactcatgtatgtgtcacgaagttctggtgctgtttttttcagctccatcaggtcatttatgttcttctctaaactggttattgtagttagcaattcctctaccctttatccaaggttattagcttccttgcattgagttagaacatgctcctttagcttggaggagtttgttattacctaccttctgaagcctacttctgtcaattcaccaaactcattctctatccagttttgttcccttgctgtcaaggagttgtgatcctttggaggaaaagaggcattctggtttttggaactttccgcatttttgcactgggttttcctcatcttcatggatttatctacctttggtctttgatgttggtgacctttggatggggtctctgagtggaagtcctttttgttggtgttgatgctattcctgtttgttagttttccttctaacagtcaggcccctctgctgctggtctgctggagttggctggaggtccactccagaccctgtttgcctgggtatcaccagcggaggctgcagaacagcaaagattgctgcctgttccttactctggaagcttcgtcccagaggggcattgccagatgccagcagagctctcctatatgaggtgtctgtcaacccctgctgggaggtgtctcccagtcaggaggcacggggttcagggaccaacttaaggaggtagtctgtcccttagcagagcttgagtgctgtgctgggagatccactgctctcttcagagccggcaggcaagaatatttaagtttgctgaagctgtgcccacagctgccccttccccaaggtcaaaaatttaaaattttaagtgactacttgaaaaataaaatatctaaatgatcagatccttattatcttcctctaagtcatctttggagatatctaacatctgtgatctgtgtaatgatttttaattctagcttataaatgacaagccaagacctttgccagtattttctttcaacttgatatttttgtcagacctctggaattatacatcatgtatctgatttaaagatttaattatcatagtttattcacctatcataattaatcatgcttagttaaaaagtctcatttcacagctacaaaaagcaaatactcatattcaaatttcactgtgcagaaacaagctaatcttttattagaaatatggctcccttccaaaaaggaaacagctttaattactaagaaactatgaagcaaatcatttggaccaacaatgactttgtttcaatgttctctcacataagccttactttattctttaaaagatgaatttagtcattagtagtacaacagggatacctgtttatgtaattaataaactaagcagatagtcccaagattaaatgttaccctgctacaatttttaacaaaagtgacggattctttcctaatatttgcctgccatttaacataaagtcataaagattttctgctcgagatgttttatgaagcacaaaacgacctcctttttaaaccaaagcaagattggctaatcaaattttttataactgcgaaacattacataacagggactgtgctttttatgtatcctttagctaacaaactgttactaaattttattacctcaaagacaactgaacacagaatggactactgcctttttgcctacacttcttacctaaaactaagcccttttgttctccaatacattaacagttcatttcaatttctggtatttgaaacgtaggtgtgatctaaagtctttgcacgtaattttaaaacaaaagcacttctgatagtttctaaacataaatgaggcaacacttcacttcttctttagttaccgctgtggcaggtcctcacctattcctgatttcaaagagtaaaactcattttctagaggagactgactctgtaaaaggttgataaatagagtatttataaatcacatgacaaaaaatgctataaactaggtacttataggttcaattatatattttttttaatttttaaacttttaggttcacgggtaacgtgaatgtttgttacacaagtaaactcatgagaacaaagttacaacacatcagaatctctgggacacagctaaggcagtgttaagagggaaattcgtagcactaaatgcctccatcaaaaagttagaaagatctcaaattaacaacttaacatcacaactgaaagaattagagcagcaataacaaatcaaccccaaactagcagaagacaagaaataaccaaaatcagagctgaactgaaggaaatcaagatatgaaaaaccattcgaaaggtcactagatccaggagttgtttttttgaaaaacttaatgagatagataggccactagctagactaactgaattatattttaaatgcactagaggagctgactttctaagaaatattatcattaactctttaatatacctgttttttaaaattcatacatttctaatagacagcagaaaataactaattagtatactgacagttgaaccttttttaatatttataattaaaaaatgaagtttattttatttttttaatatacttaaagttctagagtacatgtgcacaacgtacaggtttgttacatatgtatacatgtgccatgttggtgtgctgcacctgttaacttgtcatttatattaggtatatctcctgatgctatccctccaccctcctcctaccccatgacaggccctggtgtgtgatgttccctaccctgtttccaagtttttcattgttcaattcccacttatgagcacgaacatgcagtgttcggttatctgtccttgcgatagtttgctgagaacgatggtttccagcttcatccatgtccctacaaaggacatgaactcatcctattttatggctgcatagtattacatggtgtatatgtgccaaattttcttcacccagtctattgctgatggacatttgggctagttccatgaatatagcagcatgatttataatcctttgggtatatacccagtaatggaatggctgggtaaaatggtatttctagttctagatccttaaggaatcaccacactgtctgccacaatggttgaactagtttacagttccaccaacagtgtaaaaatgttcctatttctccacatcctctccagcacctgttgtttcctgacattttaatgttgccattctgactggtgtgagatggtttctcattgtcgttttgatttgcatttctccgatgatgagcattctttcatgtgtctgttggctgcataaatgtcttcttttgagaagtgtctgctcatatccttcgcccactttttgatggagttgtttttttcttgcaaaatttctttaagttctttatagattctggatattagccctttgtcagatgcgtagattgcaaaaattttctcccattctgtaggttgcctgttcactctgatggtagtttcttttgctatgcagaagctctttagtttaattagatcccatttgtctattttggcttttgttgccattgcttttggtattttagtcatgaagtccttgcccatgcctatgtcctgaatggtattgcctaggttttcttcttgggtttttatggttttaggtctaacatttaagtctttaatccatcttgaattaatttttgtgtaaggtgtaaggaagggatccagtttcagctttctacatatggctagccagttttcccagtaccatttactaaatacggaatgctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtacagtttgaagtcaggtagcgtgatgcctccagctttgttctttggcttaggattgtcttggcaatgcaggctcttttttatttccatttgaactttaaagtagttttttccaattctgtgaagaaagtcattggtagcttgatgaaggtggcattgaatctataaattaccttggccagtatggccattttcatgatattgattcttcctatccacaagcatggaatgttcttccatttgtttgtgtcctcttttatttccttgagcagtggtttgcagttctccttgaagacgtccttcacatcccttgtaagttggattcctaggtattttattctctttgaagcaattgtgaatgggagttcactcatgatttagctgtttgtctgttattggtgtataggaatgcttgtgacttctgcacattgattttttgtatcctgcgactttgctgaagttgcttatcagcttaaggagattttgggctgagacgatggggttttctaaatatacaatcatgtcatctgcaaacagggacaatttgacttcctcttttcctaactgaataccctttctttctttctcctgcctgattaccctggccagaacttccaacactgttgaataggagtggtgagagagggcatccctgtcttgtgccagttttcaaagggaatgcttccagtttttgcccattcagtatgatattggctgtgggtctgtcataaatagctcttattattgcgagatacgtcccatcaatacctaatttactgagagtttttagcatgaagggctgttgaattttgtcaatggccttttctgcatctattgagataatcatgtggtttttgtctttggttctgtttatatgatgggttacgtttattgatctgtgcatgttgaaccagccttgcatcccagggatgaagcccacttgatcatggtggataagctttttcatgtgctgctggattcagtttgccagtattttattgaggatttttgcactgatgttcatcagggatatggtctaaaattctctttttttgttgtctctctgccaggctttggtatcaggatgatgctggcctcataaaatgagttagggaggattccctctttttctattgactggaatagtttcagaaggaatggtactagctcctcttcgtacctctggtagaattcagctgtgaatccatctggtcctggactttttttggttggtaggctaataattattgcctcaatttcagagcctgttattgatctattcagaaattgaacttcttcctggtttagtcttcggagggtgtatgtgtccagaaatttatccatttcttctagattttctagtttatttgcatagaggagtttatagtattgtctgatagtagtttgtatttctgtgggatcggtgttgatatcccctttatcattttttattgcatctatttgattcttctctcttttcttctttattagtcttgctagtggtgtatctattttgttgatcttttcaaaaaaccagctcctggattcaccaattttttttaagggtttttgtgtctgtacctccttcatttctgctctgttcttagttatttcttgccttctgctagcttttgaatgtgtttactcttgcttttctacttcttttaactgtgatgttagggtgtcaattttagatctttcctgctttctcctgtgggcatttagtgctataaatttccctttacacactgctttaaatgtgtcccagaaattctggtatattgtgtctttgttctcactggtttcaaagagcatctttatttctgccttcatttcgttacgtacccagtagtcattcaggagcaggttgttcagtttccatgtagttgagctgttctgagtgagtttcttaatcctgagttccagtttgattgcactgtggtttgagacacagtttatcataacttctgttctttttcatttgctgaggagtgctttaattccaactatgtggtcaattttggaataagtgtgatgtggtgctgagaagaatgtacattctgttgatttggggtggagagttctgtagatgcctattaggtccacttggtgcagagctgagttcaagtcctggatatccttgttaactttctgtctcactgatctgtctaatgttgacagtggggtgttaaagtctcccattattattgtgtggagtccaagtctctttgtaggtctctaaggacttgctttatgaatctgggtgctcctgtactgggtgcatatatatttaggatagttagctcttcttcttgaactgatccctttaccattatgtaatggccttgtctctttagatctttgttggtttaaagtctgttttatcggagagaggattgcaacccctgcctttttttgttttccatttgcttggttgatcttcctccatccctttattttgagcctatgtatgtctctgcacgtgagatgagtctcctgaatatagcacactgatgggtcttgactctttatccaacttcccagtctgtatcttttaattggagcatttagaccatttacatttaaggttaatattgttatgtgtgaattcaatcctgtcatcatgatgttagctggttattttgctcgttagttgatacagtttcttcctagcatcaatggtctttacaagttggcatgtttttgcagtggctggtaccgcttgttcctttccatgtttagtgattccttcaggagctcttgtaaggcaggcctgatggtgacaaatctctcagcatttgcttgtctgtaaaagattttatttctccttcacttatgaaacttagtttggcaggatatgaaattctgggttgaaaattcttttctttaagaatgttgagcctggctgccccgtctgggaagtgaggagcgcctctgcccgggcgccccgtctgggaagtgaggagcgcctctgcccagctgtccagtctgggaagtggggagcgcctctgcccaggcgccccgtctgggaagtgaggagcgcctctgcccagctgtcccgtctgggaagtgaggagcgcctctgcccggctgccccgtctgggatgtgaggagcgcctctgcccagccgccaccccgtctgggaagtgaggatcgcctctgcctggccgcctcgtctgggaagtgaggagcgcctctgcctggccgctgtgcaatcttccaagcatgaagtgacagcctgtctgcaggggtacccaacagctctgaagagacagcgaccatcgagaacgggccatgatgactatggcagttttgtcaaaaagaaaagggggaaatgtggggaaaagaaagagagatcagattgttactgtgtctgtgtagaaagaagtagacatagcagactccattttgttctgtactaagaaaaatttttctgccttgggatgctgttaatctataaccttacccccaaccacgtgctctctgaaacatgtgctgtgtcaactcagggttaaatggattaagggcggtgcaagatgtgctttgttaaacagatgcttgaaggcagcatgctggtcaagagtcaccaccactccctaatctcaagtacccagggacacagacactgcggaaggccacagggacctctgcctaggaaaaccagagacctttgttcaagtgtttatctgctgaccttctctccactattatcctatgaccctgccacatccccctctccgagaaacacccaagaatgatcaataaatacttcaaaaaaaaaaaaaaaagcaaatcataaaaaaaaaagaatgttgaatattggcccccactctcttctggcttatagagtttctgccgagagatccgctgttagtctgacgggcttccctttgcgtgtaacgggacctttctctctggctgcccttaatattttttctgtcatttcaactttggtgaatccgacaattatgtgccttggagttgctcttctcaaggagtatctttgtggcgttctctgtatttcctgaatttgaatgttggcctgccttgctaggttggggaagttctcctggataatatcctgaagagcgttttccaacttggttccattctccccgtcactttcaggtacaacaatcaaatgtagatttggtcttttcacatagtcccgtatttcttggaggctttgtttgtttctttttattcttttttctctaaacttctcttctcgcttcatttcattcatttgatcttcaatcactgataccctttcttccacttgatcaaatcagctactgaagcttgtgcatatgtcatgtagttcttgtgccatgattttcagctccatcaggtcatttaaggtcttctctatactgtttattctagttagccattcgtctaatctttcttcaaggtttttagcttctttgtgatgggttcgaacatcctcctttagcttggagaagtttgttattaccaatcttctgaagccttcttctctcaactcgtcaaagtcattctccgtccagctttgttccgttgctgacaaggagctgtgttcctctgcaggagaagaggtgctctgatttttagaattttcagcttttctgctctgttttttccccatctttgtggttttatctatctttggtctttgatgatggtgacgtacagatggggttttggtgtggatgtcctttctgtttgttagttttccttctaacagtcaggaccctcagctgcaggtctgctggagtttgctggaggtccactccagaccctgtttgcctgggtatcaccagcggaggctgcagaagagcaaatgttacagaacagcaaatgttgctgcctgatccttcctctggaagcttcgtctcaagaggggcacccggctgtatgaggtgtcagttggcccctactgggaagtgtctcccagttaggctactcgggggttggggacccacttgaggaggctgtctgtctgttctcagatctcaaactctgtaacgggagaaccagtactctcttcaaagctgtcagacagggacgtttaagtctacagaggtttctgctgccttttgttcagctatgccctgcccccagaagtggagtctacagaggcaggcaggcctccttcagctgtggtgggttccacccagttcgagcttcccggccgctttgattacctactcaagcctcagcaatggcggacacccctcccccagcctcgctgccaccttgcagttcgatctcagactgctgtgctagcagtgagcgaggctctataggcgtgggaccctccaagccaggcgtgggatataatctcctagtgtattgtttgctaagaccattggaaaagcacagtattagggtggaagtgtcccaattttccaggtaccatgtgtcacggcttcccttggcttggaaaaggaattccctgacctcttacgcttcctgggtgaggcgatgccccgccctgcttctgctcacagtccgtgggctgcacccactgtccgacaagccccagtgagatgaacccggtacctcagctggaaatgcaaaaatcacccgtcttctgcgtcgctcatgctgggagctgtagactagagctgttcctatttggccatcttggaacctctccgaaatttattttattaaagggactccagtgaaattcatattaaattttacagta

SEQ ID NO: 1683 - DNA, 4028 bp, Homo sapiens
acacagttgtaacttagaatatgcttataatatttttaaaaatgttatagcatccttttaaagagtttatgaataatttgtgctggttttcaaggggaatgcttccagcttttgctcattcagtatgatattggctgtgggtttgtcacaaataggtcttattattttgagatatgtctcatcaatacctagtttattgagaatttttagcatgaagagatgttgaattttatcgaaagacttttctgcatctattgagataatcatgtggtttttctcactggttctgtttatgtgatggattacatttattgatttgcatatgttgaacgggccttgcatcccagggatgaagccaacttgatcatggtggataagctttttgatgtgctgctggattcggtttgccagtcttttattgaggattttgcattgatgttcctcagtgataatgacctgaaattttctttttttgttgtgtctctgccagattttggtatcaggatgatgctggcctcataaaatgagttacggaggattccctcttttctatcatttggaatagtttcagaaggaatggtaccagatcctctttgtacctctagtagaattcggctatgaatccctctggtccttttcttggttgctaggctattaattattgcctcaatttcagagcctgttattggtctattcaggaattcaacttcttcctggtttagtcttgggagggtgtatgtgtccaggaatttatccatttcttctagattttctagtttatttgcgtagaggtgtttataacactctctgacggtagtttggatttctgtgggatcagtgctgatctcccttttatcattttttattgtgtctatttgattcttctctcttttcttctttattagtcaggctagtggtctatctattttgttgatcttttccaaaacaccagctcctggattcattgattttttttgaagggttttttgtgtctcttgtcgccttcagttctgctctgatcttagttatttcttgtcttctgctagcttttgaatttgtttgccattgcttctctagttcttctaattgtgatgttagggtgtcgattttagatctttcccccttcctcctgtgggcatttggtgaaacactgctttagctgtgtcccagagattctggtatattgtgtctttgttctctttggtttcaaagaactaatttatttctgccttaattgtgttatttacccagtagtcattcaggagcaggttgttcagtttccatgtagttgtgcggtttgtagttagtttctcaatgctgacttctaatttgattccactgtggtctgaggggctgtttgttatgatttccattcttttgagtttgctgaggagtgttttacttccaattatgtggtcaattttagaataagtgcgatgtggtgctgagaagaatgtatattctgttgatttggggtggagagttctgtagatgtctattaggtccgcttggtccagagctgagttcaactcttgaatatccctttttttttttctgaatatcctttttaattttcagtctcgttgatctaatattgacagtgaggtgttaaagtctcccactgttattgtgtggaaatctaagtctctttgtaggtctctaagaacttgctttacgaatctgggtgctcctgtattgggtgcatatatatttaggacagttagctcttcttgctgcattgatccctttatcattatgtaatgccttgtttttttttttatctttgttggtttaaaatctgttttatcagtgatgaaaattgcaactcctgcttttttttttctttccatttgcttggtaaatcatcctccatccctttatttcaaacttatgtgtgtcttgcatgtgagatgggtctcctgaatacagcacactgataggtcttgcctctttatccaatttgccagtctgtgtcttttaattggggcatttagcctgtttacatttaagattaatattgttatgtgtgaattgatcctgtcattacgatgttagctggttattttgcccattagttgacgcagtttcttcatagcatcaatggtctttataatttggtatgcttttgtagtggttggtactggttgttcctttccatatttagtgctttcttcaggagctcttgtaaggcaggcctggtggtgacaaaatctctcagcatttgcttgtctgtaaaggattttctccttcgcttttgaagcttagtttggctagatatgaaattctgggttgaaaattattttctttattaatgaatataggcccccactctcttctggcttgcagggtgtctgagagagatccgctggtaagactaacagggatgggcttccctttgtgggtaacccgacctctctggctgcccttaatatattttccttcatttcagccttggtaaatctgacgattacatgtcttggggttgctcttctcggggagcatgtttgtggtgatctctgtatttcctgaattggaatgctggcctgtcttgataggttggggaagttctcctaggtaatatcctgaagagttttttccaatttggtccattctccctgtcactttcaggtacatcaatcaaacgtaggttcactcttttcacatagtcccatatttcttggaggctttgctcattcccttttgttttttttttttctctaatcttgtcttcttgctttatttcattaagttgatcttcaatctctgatatcctttcttctgattcatcgattcggctattgatactcatgtatgtgtcacgaagttctggtgctgtttttttcagctccatcaggtcatttatgttcttctctaaactggttattgtagttagcaattcctctaccctttatccaaggttattagcttccttgcattgagttagaacatgctcctttagcttggaggagtttgttattacctaccttctgaagcctacttctgtcaattcaccaaactcattctctatccagttttgttcccttgctgtcaaggagttgtgatcctttggaggaaaagaggcattctggtttttggaactttccgcatttttgcactgggttttcctcatcttcatggatttatctacctttggtctttgatgttggtgacctttggatggggtctctgagtggaagtcctttttgttggtgttgatgctattcctgtttgttagttttccttctaacagtcaggcccctctgctgctggtctgctggagttggctggaggtccactccagaccctgtttgcctgggtatcaccagcggaggctgcagaacagcaaagattgctgcctgttccttactctggaagcttcgtcccagaggggcattgccagatgccagcagagctctcctatatgaggtgtctgtcaacccctgctgggaggtgtctcccagtcaggaggcacggggttcagggaccaacttaaggaggtagtctgtcccttagcagagcttgagtgctgtgctgggagatccactgctctcttcagagccggcaggcaagaatatttaagtttgctgaagctgtgcccacagctgccccttccccaaggtcaaaaatttaaaattttaagtgactacttgaaaaataaaatatctaaatgatcagatccttattatcttcctctaagtcatctttggagatatctaacatctgtgatctgtgtaatgatttttaattctagcttataaatgacaagccaagacctttgccagtattttctttcaacttgatatttttgtcagacctctggaattatacatcatgtatctgatttaaagatttaattatcatagtttattcacctatcataattaatcatgcttagttaaaaagtctcatttcacagctacaaaaagcaaatactcatattcaaatttcactgtgcagaaacaagctaatcttttattagaaatatggctcccttccaaaaaggaaacagctttaattactaagaaact

SEQ ID NO: 1684 - DNA, 21986 bp, Homo sapiens
tcattaactctttaatatacctgttttttaaaattcatacatttctaatagacagcagaaaataactaattagtatactgacagttgaaccttttttaatatttataattaaaaaatgaagtttattttatttttttaatatacttaaagttctagagtacatgtgcacaacgtacaggtttgttacatatgtatacatgtgccatgttggtgtgctgcacctgttaacttgtcatttatattaggtatatctcctgatgctatccctccaccctcctcctaccccatgacaggccctggtgtgtgatgttccctaccctgtttccaagtttttcattgttcaattcccacttatgagcacgaacatgcagtgttcggttatctgtccttgcgatagtttgctgagaacgatggtttccagcttcatccatgtccctacaaaggacatgaactcatcctattttatggctgcatagtattacatggtgtatatgtgccaaattttcttcacccagtctattgctgatggacatttgggctagttccatgaatatagcagcatgatttataatcctttgggtatatacccagtaatggaatggctgggtaaaatggtatttctagttctagatccttaaggaatcaccacactgtctgccacaatggttgaactagtttacagttccaccaacagtgtaaaaatgttcctatttctccacatcctctccagcacctgttgtttcctgacattttaatgttgccattctgactggtgtgagatggtttctcattgtcgttttgatttgcatttctccgatgatgagcattctttcatgtgtctgttggctgcataaatgtcttcttttgagaagtgtctgctcatatccttcgcccactttttgatggagttgtttttttcttgcaaaatttctttaagttctttatagattctggatattagccctttgtcagatgcgtagattgcaaaaattttctcccattctgtaggttgcctgttcactctgatggtagtttcttttgctatgcagaagctctttagtttaattagatcccatttgtctattttggcttttgttgccattgcttttggtattttagtcatgaagtccttgcccatgcctatgtcctgaatggtattgcctaggttttcttcttgggtttttatggttttaggtctaacatttaagtctttaatccatcttgaattaatttttgtgtaaggtgtaaggaagggatccagtttcagctttctacatatggctagccagttttcccagtaccatttactaaatacggaatgctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtacagtttgaagtcaggtagcgtgatgcctccagctttgttctttggcttaggattgtcttggcaatgcaggctcttttttatttccatttgaactttaaagtagttttttccaattctgtgaagaaagtcattggtagcttgatgaaggtggcattgaatctataaattaccttggccagtatggccattttcatgatattgattcttcctatccacaagcatggaatgttcttccatttgtttgtgtcctcttttatttccttgagcagtggtttgcagttctccttgaagacgtccttcacatcccttgtaagttggattcctaggtattttattctctttgaagcaattgtgaatgggagttcactcatgatttagctgtttgtctgttattggtgtataggaatgcttgtgacttctgcacattgattttttgtatcctgcgactttgctgaagttgcttatcagcttaaggagattttgggctgagacgatggggttttctaaatatacaatcatgtcatctgcaaacagggacaatttgacttcctcttttcctaactgaataccctttctttctttctcctgcctgattaccctggccagaacttccaacactgttgaataggagtggtgagagagggcatccctgtcttgtgccagttttcaaagggaatgcttccagtttttgcccattcagtatgatattggctgtgggtctgtcataaatagctcttattattgcgagatacgtcccatcaatacctaatttactgagagtttttagcatgaagggctgttgaattttgtcaatggccttttctgcatctattgagataatcatgtggtttttgtctttggttctgtttatatgatgggttacgtttattgatctgtgcatgttgaaccagccttgcatcccagggatgaagcccacttgatcatggtggataagctttttcatgtgctgctggattcagtttgccagtattttattgaggatttttgcactgatgttcatcagggatatggtctaaaattctctttttttgttgtctctctgccaggctttggtatcaggatgatgctggcctcataaaatgagttagggaggattccctctttttctattgactggaatagtttcagaaggaatggtactagctcctcttcgtacctctggtagaattcagctgtgaatccatctggtcctggactttttttggttggtaggctaataattattgcctcaatttcagagcctgttattgatctattcagaaattgaacttcttcctggtttagtcttcggagggtgtatgtgtccagaaatttatccatttcttctagattttctagtttatttgcatagaggagtttatagtattgtctgatagtagtttgtatttctgtgggatcggtgttgatatcccctttatcattttttattgcatctatttgattcttctctcttttcttctttattagtcttgctagtggtgtatctattttgttgatcttttcaaaaaaccagctcctggattcaccaattttttttaagggtttttgtgtctgtacctccttcatttctgctctgttcttagttatttcttgccttctgctagcttttgaatgtgtttactcttgcttttctacttcttttaactgtgatgttagggtgtcaattttagatctttcctgctttctcctgtgggcatttagtgctataaatttccctttacacactgctttaaatgtgtcccagaaattctggtatattgtgtctttgttctcactggtttcaaagagcatctttatttctgccttcatttcgttacgtacccagtagtcattcaggagcaggttgttcagtttccatgtagttgagctgttctgagtgagtttcttaatcctgagttccagtttgattgcactgtggtttgagacacagtttatcataacttctgttctttttcatttgctgaggagtgctttaattccaactatgtggtcaattttggaataagtgtgatgtggtgctgagaagaatgtacattctgttgatttggggtggagagttctgtagatgcctattaggtccacttggtgcagagctgagttcaagtcctggatatccttgttaactttctgtctcactgatctgtctaatgttgacagtggggtgttaaagtctcccattattattgtgtggagtccaagtctctttgtaggtctctaaggacttgctttatgaatctgggtgctcctgtactgggtgcatatatatttaggatagttagctcttcttcttgaactgatccctttaccattatgtaatggccttgtctctttagatctttgttggtttaaagtctgttttatcggagagaggattgcaacccctgcctttttttgttttccatttgcttggttgatcttcctccatccctttattttgagcctatgtatgtctctgcacgtgagatgagtctcctgaatatagcacactgatgggtcttgactctttatccaacttcccagtctgtatcttttaattggagcatttagaccatttacatttaaggttaatattgttatgtgtgaattcaatcctgtcatcatgatgttagctggttattttgctcgttagttgatacagtttcttcctagcatcaatggtctttacaagttggcatgtttttgcagtggctggtaccgcttgttcctttccatgtttagtgattccttcaggagctcttgtaaggcaggcctgatggtgacaaatctctcagcatttgcttgtctgtaaaagattttatttctccttcacttatgaaacttagtttggcaggatatgaaattctgggttgaaaattcttttctttaagaatgttgagcctggctgccccgtctgggaagtgaggagcgcctctgcccgggcgccccgtctgggaagtgaggagcgcctctgcccagctgtccagtctgggaagtggggagcgcctctgcccaggcgccccgtctgggaagtgaggagcgcctctgcccagctgtcccgtctgggaagtgaggagcgcctctgcccggctgccccgtctgggatgtgaggagcgcctctgcccagccgccaccccgtctgggaagtgaggatcgcctctgcctggccgcctcgtctgggaagtgaggagcgcctctgcctggccgctgtgcaatcttccaagcatgaagtgacagcctgtctgcaggggtacccaacagctctgaagagacagcgaccatcgagaacgggccatgatgactatggcagttttgtcaaaaagaaaagggggaaatgtggggaaaagaaagagagatcagattgttactgtgtctgtgtagaaagaagtagacatagcagactccattttgttctgtactaagaaaaatttttctgccttgggatgctgttaatctataaccttacccccaaccacgtgctctctgaaacatgtgctgtgtcaactcagggttaaatggattaagggcggtgcaagatgtgctttgttaaacagatgcttgaaggcagcatgctggtcaagagtcaccaccactccctaatctcaagtacccagggacacagacactgcggaaggccacagggacctctgcctaggaaaaccagagacctttgttcaagtgtttatctgctgaccttctctccactattatcctatgaccctgccacatccccctctccgagaaacacccaagaatgatcaataaatacttcaaaaaaaaaaaaaaaagcaaatcataaaaaaaaaagaatgttgaatattggcccccactctcttctggcttatagagtttctgccgagagatccgctgttagtctgacgggcttccctttgcgtgtaacgggacctttctctctggctgcccttaatattttttctgtcatttcaactttggtgaatccgacaattatgtgccttggagttgctcttctcaaggagtatctttgtggcgttctctgtatttcctgaatttgaatgttggcctgccttgctaggttggggaagttctcctggataatatcctgaagagcgttttccaacttggttccattctccccgtcactttcaggtacaacaatcaaatgtagatttggtcttttcacatagtcccgtatttcttggaggctttgtttgtttctttttattcttttttctctaaacttctcttctcgcttcatttcattcatttgatcttcaatcactgataccctttcttccacttgatcaaatcagctactgaagcttgtgcatatgtcatgtagttcttgtgccatgattttcagctccatcaggtcatttaaggtcttctctatactgtttattctagttagccattcgtctaatctttcttcaaggtttttagcttctttgtgatgggttcgaacatcctcctttagcttggagaagtttgttattaccaatcttctgaagccttcttctctcaactcgtcaaagtcattctccgtccagctttgttccgttgctgacaaggagctgtgttcctctgcaggagaagaggtgctctgatttttagaattttcagcttttctgctctgttttttccccatctttgtggttttatctatctttggtctttgatgatggtgacgtacagatggggttttggtgtggatgtcctttctgtttgttagttttccttctaacagtcaggaccctcagctgcaggtctgctggagtttgctggaggtccactccagaccctgtttgcctgggtatcaccagcggaggctgcagaagagcaaatgttacagaacagcaaatgttgctgcctgatccttcctctggaagcttcgtctcaagaggggcacccggctgtatgaggtgtcagttggcccctactgggaagtgtctcccagttaggctactcgggggttggggacccacttgaggaggctgtctgtctgttctcagatctcaaactctgtaacgggagaaccagtactctcttcaaagctgtcagacagggacgtttaagtctacagaggtttctgctgccttttgttcagctatgccctgcccccagaagtggagtctacagaggcaggcaggcctccttcagctgtggtgggttccacccagttcgagcttcccggccgctttgattacctactcaagcctcagcaatggcggacacccctcccccagcctcgctgccaccttgcagttcgatctcagactgctgtgctagcagtgagcgaggctctataggcgtgggaccctccaagccaggcgtgggatataatctcctagtgtattgtttgctaagaccattggaaaagcacagtattagggtggaagtgtcccaattttccaggtaccatgtgtcacggcttcccttggcttggaaaaggaattccctgacctcttacgcttcctgggtgaggcgatgccccgccctgcttctgctcacagtccgtgggctgcacccactgtccgacaagccccagtgagatgaacccggtacctcagctggaaatgcaaaaatcacccgtcttctgcgtcgctcatgctgggagctgtagactagagctgttcctatttggccatcttggaacctctccgaaatttattttattaaagggactccagtgaaattcatattaaattttacagtacagcaaagagtatttatgatctttaaacttgttttaaaaacaatatgtgcttttggaaaaaagttctagataagaccagataaaatatatatatacattatttaaatcattatttagtaataaaaatacaacaataaaacatatttttataatcatttatgctacatttccaaaatgtttttcaaactgtatcttaatttaaaaactatacacaatatatatgtattatgtagcacatatattaattaactgattcactaaccactatgtaaaaaccatggtgctaggtcaatgcagtagccatgggatagtagaaatagcccaaagatgatacttataagctcatagtctactagagcaatgcagaaaacaaaataaaggtccagttacagtggctcatgcctgtaatagcagcactttggtaggccaaagtgggaagatcatttgcgccaaagaattcaagacaaacctgggcaacatagtgagacccatctctacaaaaaaattaaaccagccaggtgtagtggtgcacacctgtggccccagctacttgggaggctgaggtgggaagatcacttgggctcaggaggttgaggctgtagtgagctgtgattgcaccactgcattccagcctgagcaacacggtaaaccctgtctcaaagaaataaagtaaaataaataaaaatataatgtattaagtaatagccacatatataaattgttacaggtatataacctacaggaaaggccaaacagtattaggtaagtatccaaccttggaagaataagaaaaggtttactaaatgaaggtaaataaataagttagatcttaaattttttgtagatattgccatccctaaaagagaggaaactatgtgaaagaagcagtctttttaaagtgcatttttattttggaaaaacagccagatataactgaaaattcagagatgtgggaaaaaactacaatggaggcaaatctctaaatgcaaaatattgagtcttatgctcttgaaaaaaaaagaggtttggattgaaaaatttatgtttctgaaaaataatctggcaataggtagagattatatgatgtcaagaagtcacccacagcatgaaaaaaaaacaggaggttatagatacaattttatcagaaaattccatgtctagaatgtctattgctatcactatcaatttacttatctttcaaaatctaactctacagtgcttcctacaagaatcattcttgaggtccgaacacagttagcaatcaaaacaaggctgacagatttgtccagtaagaaaacaatgagtaatttttggattcagacagtttattacctacataaacagcaaaagcaagaatagacaaaggtgccagctactagtatcccttgcacaggatgacattgaaacaaaggggccagatgactataacaaagatgtaggacactctgttgcggagaagcccatgccgtgctgcagtaaagcagttttataagctgtagctatgccccaaggagagcaaggcagaaagcccagtgctcgtcggaacctaggaaccaataagaaacgggctcctaactgacttcctaatagactgtgaagtaagtgagaatcaatcttgcatagtcagctgctcataagcctttcatattctcatgttccagaaggatcacaggaaattctgccaagatttagattggctgtagttaagccttgtctatgaagcccaagggcagatatgcaaaattgtcaggccactgtgatgaggctgttctcatagaactatgtacaaccatatcattgtcgtatttattatatcacagtagaaatattttgacctaaattgatgataaaaacatggcataaggccatgcttagaggattagagctaaaaacacacatttgagaaagacttttaaaaaaatcaatgacgtaagcctctaccttaaaatgttagaaaaaagagctgtaaactaaactaaaagtagaaggagataataaatattggcagaaataaaacaggagaaaaaagttaaagagaggctcaacaaagccaaaggttcattctattagaaagataaaccaagaaaaattgagaaaggaataattaatgtctgcaatgaaaggggacctcactacagattcagcagacattaaaagtgtaagatgatttgatgaataccttcacagtaacaaattttaaaaattagataaaaagtttttaagttctacaaaaacataacttactaaggctgacacacataaaaagaaactctgaacgattttagatctatttaaaaagtcatttcaggccaggcgcagtggctcacacccgtaatcccagcactttgggaggccaagacgggtgtggatcacctgagatcaggagttcgacaccagcctggccaacctggtgaaaccctgtctctactaaaaagacaaaaattagctgtgcgtggtggcaggcgcctgtaatcccagctacttgggaggctgaggcaggagaatcacttgaacccgggaggcagaggttgcagtgagctgagatcatgccattgcactccagcctgggcaacagagcaagactctgtctcaaaaaaaaaaaaagtcatttcatttcacaatttacaatcttcccaaaaagaaaactgcaaaccaagattgtttcacgatcaaattctacctaacattagagaacaaaatcacaccaatgcaaatcagctattccaaaaaagaaagttatataaaggaaaagatttaaaatggttgaaaaagtcacgttcttacaatctcacattctcccattttagtcataagaacggaatgattttgattattaaaaacctgacaaattctttaagagaaaaaagatgcaaaattcgaaaaacttttttacatgaggaaatagaataattctaaaaacttcagaattctaaaaaattgagaaacgaaatccactaacatataaaaagagtaatacatcacaacctaactgaaatgtttcgagaaatgcaaggttgtttaacattttaaaatcaatcagtaatggaatataagggaaaaatcatgtgattatcttaaaagatacagaaaaaagcaatatacaattatgaattaaaaaacaaagctcctagcaaaacaggacaaaagaaaacttccttaacttgatctttcttaattgacaaaaaaaaactataaacagcatactgaagggtgaaaaattaaaggcttttgttttgatattggaaataagaattgcctgatacatggtcaacatataaaaattggctatatttacatatttcaataacagaagataaaatttcaaaaaagatgctcattttcaccaaaagataagaatgttcatagcagtagcatctagaactgcacaaactggaagaaaaagaaaaaacaaatatcctttaacattgtacagcctgagtatgccgtatacaaaatgcttgggaccagaagtgtttgaattttggagttgtttggattttgaaatacctgtatcatatacttactggttgagcattcctaatccaaaaatccaaaatctgaaatgctctagcgaacacttcctttgagcatcaaaagtttccatttatttcttttgaaaatgagggtatttataaaagtgaccttccttacttaactattaataaaaatcactaaaacatttcactattatgacttatataaataatgtataatattctacattgaatagagtaacgtataatgcacttgtggcctggcataaagtaaaagcaactaatagtaaataactaccatatgctatttttacttacctcaaggagacctgacaagtacttcacacagatatctagaggctttgtgagaggagagtgtgagctccatcccggaaacgcagtgaggttagccatccctcgtaaggtccgctcaagggacggcaggccatagaaatgaggcgcatccgtcactttcagacactggagcagtttcagagccagctgcgtttgaaaaacgtaaagaagttccgagcatttcctatgtatgcaaaagagggaaaatcaaccaccaagaaagtataatgggcttaatgggctatcttactggctataaaaggttacttaaactcatagtaatagaaaaaaatgaaccagacaaaatggcagaaaatagtctctatcaaaatgagacttttcaaggaaagcataaaataccaactagagaatgtcatataaaatacaagtaacgattacactgggccaggggctgtggctcacccctataatcccagtgccttgggagcctgaggtgggaggattgcttgcggccagcttgagcaacacaacacagtgagacctcatttctaaaaaaatgaaataaaataaaattaaagtaaaaaaaattagccaggtgtggtggtgcacacctatagtcccagctactcaggaagctgaggcaggaggatctcttaagccctggagcttgaggttacagtgaactaagaatgtgtcactgcactccagccggggtgacatagtgagacccccatccctttttaaaaaaaaaaaaaaaaaggttggggggattgctggcaagatggtcaaataggaatagctccagtctgcagctcccggcaagatcgacgcagaaggcgggtgatttctgcatttccaactaaggtacccggttcatctcactgggactggttggacagtgggtgcagggcacagagggcaagctgaagcagggtggagcatcgcctcacctgggaagcgcaaggggtcggggaattttctccaccacccaagggaagccgtgacagactgagcctgaggaactcctgcacagatactgcgcttgtcccacggttttcgcaacctacaaaccaggagattccctcggttgcctaccctaccagagccctaggtttcaagcacaaaactgggcggccatttgggcagacaccaaacaagctgcagtagttcttttttcccataccccagtggcgcctggaacagcagcgagacagaagtgttcactccgctggaaaggggtgctgaagccagggagccaagtggtctggctcagcaggtcccactcccacggagcccagcaaactaagattcactggcttgaaattctcgttgccagcacagcagcagtctgagattgacctgggacgctagagcttggtgaggggacgggcgtccgccattgccgaggcttgagtaggcagttttacactcacagtgtaaactaagccactgggaagttcgaactgggcagagcccactgcagctcaacaaggctgccatggccagattgccagatttcccttgtctgggcagggcatctctgaaaaagtggcagcaaccccagacagggacttatagataaaacccccatctccctgggacagagcacctggagaaaggggaggctgtgggcgcaacttcatcagatttaaacatccctgcctgacgactctgaagagagcagtggacctcccagcacaccgatcaagctctgctaagggtcagactgcctcctcaagtgggtccctgacccccgtgtatcctgacggggagacacctcctagtaggggccaaccgacacttgatacagaagagctctggctggcatctggcaggtgcccctctggaacgaagcttccagaggaaagatcaggcagcaatctttgctgttctgcagcctccgctggcgatacctaggcaaacagggtcgagagtggacctctagcaaactccagcagaccggcagcacatgggcctgtcagaaggaaaactaacaaacagaaaggaacagcacgtccactcaaagatcccaaccgaaggtcaccaagaaaggatatcagtgatagaagatcaaattaatgaaataaaatgtgaagacaagattagagaaaaaagaataaaaaggaacaaacaaaggctccaagaaatatgggactatgtgaaaagaccaaatctatgttcgattggtgtacctgaaagtgacagagagaatggaaccaacttggaaaacactctgcaggatattatccagaagaacttccccaatctagcaagacaggccaacattccaattcaggaaatacagagaccaccacaaagatactcctcaagaatgcataatcatcaagacacataatcatcagatttaccaaagattaaatgaaggaaaaaatgttaagggcagccagagagaaagatcaggttacccacaaagggaagcccatcagactaacagcagatctctcagcagaaacctacaagccagaagagagtgggggccaatattcaacctttctaaagaaaacaattttcaacccagaatttcatatccagccaaactaagcttcataagcaaaggagaaataaaatcttttacagacaagcaaatgctgagagattttgtcaccaccaggcctgccttacaagagctcttgaaggaagcactaaatatggaaaggaaaaaccggtaccagccactgcaaaagcataccaaattgtaaagaacatcgacgctatgaagaaactgcatcaactaatgggcaaaacaaccagctagcatcataatgacaggatcaaattcacacataacaatattaaccttaaatgtaaacgggctaaatgccacaattaaaagacacagactggcaaattggataaagagtcaagacctatcagtgtgctatattcaggagacccatctcacatgcaaaaaacacacatgggctcaaaataaagggatggaggatgatttatcaagcaaatggaaagcaaaaaaaaaaaaaaaaaagcaagagctaccatccttatctctgatacaaaagacttaaaaccaacaaagatcaaaagagaaaaagaagggcactacataatgataaagggatcaatacagcaagaagagctaactatcctaaatatatatgcacccaatacaggagcacccagattcataaagcaagttcttagagacctacaaagagacttagactaccacacaataacagtgggagattttaacaccccactaccaatattagacagatcaacaagacagaaaattaacaaggatattcaggacttgaactcagctcttgaccaagcggacctaataggcatctacagaactcttcaccccaaatcaacagaatatacattcttcttagcacttcatcgcacttattctaaaattgaccacataattggaagtaaaacactcctcagcaaatgcaaaagaacgcaaatcataacaaacagtctttcaaaccacagtgcaatcaaactggaactcaggattaagaaactcactccaaaccgcacaactatatggaaaccgaacaacctgctcctaaatgactactgagcaaataacgaaatgaaggcagaaataaagatgttctttgaaatcaatgagaacgaagacacaatgtaccagaatctctgggacatatttaaagcaaaaaacaaaacaaaacaaaaaaggaaaatttcaggccaatatccctgatgcacactgatactaaatcctcaaagatgttgaataggtatttctccgaagaagatacacaaatagccataagaacatgagaagatgctcaaaattatttttcattggggaaatgcaaataaaaaccaaaatgataccagtctacacccattaggatgctataataacaggtgttggtgaggatatgaagaaaatgaaacactcatacattgctggtgggaatgtaaaatggtatagctgctgtggaaaacagcttggcatttccttgaaaagtcaaacatagagttaccattacagttaccatatgaaccaacaattccactcctaattatatactcaagagaactgaaacacatgtccacacaaaaatctgtatatgagtgtttacagcaacactattcataatagccaaaaggtagaaacagatcaaatgtccaccaatgaatgaatggataaacaaaacatggcatatctataaatagaatattattcagtcatagaaagaagtagtgatatttgctacagtatgcaaggagcttggaaacatgatgctaagtgaagaagctagacgctaaaggtcacattattgtttgatttcatttatgtgatatatccagaataggcaaatccacagacatagaaagaagactagtggctgccagggcccagaggaatgtgtgaatagggagagactttttcatggatacaaggcttctcttggggtgatgataaagttctggaattaggtagtggtgacagttgcaaacattgcggatatactaaaaccattcaaatgtacattttaaaatggttaaaatagtgactttcatcttaatatttttatttttaaaaaacagaattcataactagagatatgtatttgaaagtcatcagtgtaaagataatcataaagtcataggcataggtatgactgctcaagtagatttgtagataattaagagagaaccaggaattaaaccctagagaacaaaactgtgtgtgtgcatatgtgagtgcatgtgtgtagtgaaagagaccaagcaggtacaatcaggctgtaacagattaaactgaaacaaaaacaaacagaacactataactgattattatttaagtatttgaaagaagtatttcttaatttgaaagaagtacaaagtaaaactttgaaaatcaaagaaaacttgggttctatataaatgcacctaaacctgcaatattacaaatggtacctgtcagtaacttccatgaaattgagcagcaaggtatcaaaaagagcaatcagttctttctgaagttgttgcctgacagcagtccggatatcatctgtttcttctcgtgcctgtgactctgtcagaaccaagaggtctaacagtgggtttgcactctaaaaaatgaaatttgtaaaaaatgtatttactaattgaactatatattgtttcctataaagggtttggttgctaagcaagttctagtaagagctatattacctaactagtaggtgtgggcctttactgcattagtagagatgttctaaattcaaaagatgtttaatatattctcaacaaaagaaaaacatatttatcatataaaatagaaaaaaaggacgagaaaaacaaaaccacacataatcatgccacacagaaattgccactattatatattgatatataactctcctttttgtttctgagaatataaacagaattaaaacagtacatttttcacaaacccgtatcaagtgaaaaaaatcactactgtaaccattttttcctacttcccgttattaacaatatttctgcaaaaacattagtttaatatctgattgtttttcaacaataaggatttaccacactaactcctggataatcaatgatgcataatttcactaagctgcaacacacagtgtactcaagttggattttatcttatgtatgaattctgcaataaaattactaaatcaaaatattatagtagttttaattttttgatatatattgccaaattgtccctgtaaaaaatgtaccaatacatacaattacacaggacatgaaaagacccacagcacccaagccagtgctatgtggattattactgcaataatctttgccaccttgataggctagtaaacaaatactagttctttctaaagtttttcctcttttcccaactaaaaaaaaaatagataaaggaatataagaggattatttctaataatattgacaaaagaaaacgttacattaatcagaagcattaatagatatatgggatatttattaatcatctatgatgcctcaggcactgtgctaaaaaaaaaagatagtaagatttcatttgactttttgaataaactagaagatttgcattttcattcctgttttacagatgggaacatagatttataaagaggttaaataattgtctaagtcttagacagacaagggcagagcaagaagcatcttactccaaagctagttaatattccatcctcagcacagtgtcacatcactagtgcatgtaaaaacatacaaaaagagatacaatcaaaatgtaactattgttcttataaaatccttcacctaaaagagctcaactcaaaattaactgcattctctttagggaaaagaaatgaaaatatgtaaagaaacctctaaattgcttatagtatatagagatatatacaattataaataatataactgagagcttttggaaactagtagtgacattttgctcttattttacagtattttaacatctaaatagtttttttcccaactttttcttttatcttaagcaatatatgtctttggataaattaagattgaataagacataactgcaacttttatgtttcatacatgaataaaagaatcgaaatacacatttagtaaatcataaaaataaataaattttctataatgttctgagccctaaatatccaaaagctgactcacattcacgtgccttctgactcccaaaactactgacaaaatgaacaaactgtttataccaagacgcaaactccatcttgtaaaacaattttattattaggaattattaattctgatatgctgataaaaattaagtagaagctactattaatacatgaatatactgaaacagtatgtgtatacctaaaaattaagattctcccaaagaatctcatcctattaataacttgcttccacttgaagattactgaagtttttttttctcttttcacctttgatttacatgttaacactgaaattcagtgaacctcagcaataccacttgtaaaatatagggtgaattaccatttctcaagtacaatagagtagaataagatgtctctactgatgcctacagatgtcaagtgcttaatcatatctgaagtttttgtctttagacgttaggattcaatcctaattttaaaccaactacttgggccattattttgtcactgttgacctctaaaaggcaaccatttctataatgatggctcattttgtttacacacacagttaccactcatcatatccaactttacatccatcagcaagctatgccaaaagtaactgcaagaccctcaataatgtctgagtgcacattgagcccgttacgggaaagccagccaaggaaaatatatatgctgtgtagttctgctgagcttcaccaaaagaagaaaaaaactaacagccccacatttgtgaacttccatcaaaaaaatgcattccaaaaagaaaggtattcaaattcagcacttctaggttactataaacaaaatatcatattaaaaacagattagaggtgcaataaactcctaaattgcctaagaattacaatatgtttgtaataagtgaatgtcttgataaaacacatggaaaaaaatttcacaagagaaagttcctaaatcttccctcgggaagttagctgatttttcttttcacttcctcttagcattcttctgactaatcaggcgttcatatctgcctaattttgtttttgcaaccacaacttttgtatatcttttcatgtatgtccatacattcaaagcaatttacttggaaatgttattttactgagcttcttaaatcatttctcacttattttactcacttcaaaggataaactttaaaaggtacttgattttctatttccaggttccctttatcctaaacattggtagttatataacatatattaatttatcttgtagcataatatttagggagtaaacccaactgatagtgaacacttaagttcacttttgtgcactcttaaaagtagtattatttataacacttgtggtgataatatatgagataaagtagaagctttccgaagaaaggtttaataccatacaaaaccaaataagtaaatgtaactgtaccaaaaatccttttcaaaaactgcattaaaattatagtacaatcatctagagtcttgtaggaatttaattttaatttcataactatgaataaattataaaatatacataaaccttatgacatactacaaaattaacagtacatgtatggtgttacaagtcttaacaaatataacaagactgaaatcatatctaatatcatttctgaccatagtgataaaaaactagaagtcaccaaaagaaggaattctggagtattcacatatacataaaaattaagcaacatgctcctgaacaatcagtgggtcaaagaaaaagctaaaagggaaattttaaaatatcatgagacaaacaaaaatggacaccaaaccaaccaaaacttatgggatacagcaaaagcaggtctaagaaggacatacataacaataaacatctatgtcaaaaagaaagatatcaagtaaacaacctcaaggaactagaaaaagaagcataaatgaagccaaaacttagtaaaaagaaaacaatgaagataagggcagatacaaatgaaatagaaactggaaaaacaatagaaaacagtaacagaatcaagaattgagattttgaaaagatgaacaaaattgacaaacctttagctagactaataaaaaaagaagacaaaatgagaaacgaaaagggaagacattacaacagataccacagaaacacaaggaatcgtaagagactattatgaacaatttcatgtcaacaaattggacaaccaagtggaaaaaattctagacacatagagctaccaagatggaatcatgaagaaacagaaaatctgaacagaccaataataaggagattaaatcagtaatgcaaagtctttcaccaaaaaaaagcccaagacctgattgatggcttcactgctgaattccaccaaacatttaaagaattaatactaatctctgtactcctaaaaccaaatgaagaaggaatacttccaaactcactttatgacggcagcattacactgataccaaagccagacgtgggaactacaagaaaagaaaattacaggctaatatccctgataaacacagatataaaaaatcctttaccaaatactggcaaactgaaaccaagagcacaataaaaagatcactcactataatcaagtggaattcattccagggatgcaaggatggttcaacatacacaaatgcgtaaatgtgatacaccaaattaacagaattaagaacaaaaaccacatgattataccaacagatgcagaaaaagcatttgacaaaattcaacatcctttcataataaaaactctcaataaattaagtagaaaaggaatcccaacacaataaaggccatatatgaaaaacccacagctaacatcattctcaatggtgaaaagtttaaagctttttctctaagatcaggaacaagacaaggatgtctactctcaccatgtctattcaatatggtactggaaatcctagccagagcaattagtatatagaaagaaataaaaggcatccacattagaaaaaaggcaagttaagctgtccctctatgctgatgatataatcttaaatctagaaaaacctagactccaccaaaaaactttgatcttaaaaatgaattcaataaagttgcaggatacaaaatcaacttataaaaaatcagtagcatttctatacagtaaccgcgcccccccaaaaaaaaacctcatttaaaatagctaccaaaaaaaattaagatatttaggaataaatttaatcaaaaggtgaaagatctctacactaatgtccaagttgcaggtaccagaatgaaatcacgctccaaggaaaggggaggggagggaagaggaaaatggaaggaaaaagcaaaggagaaagggaagggagaagggaagggaggaaaagaaaggacaggaaagaagaaatgaaaggagactaacaacccaattgtggcggagaaccagcaaggacatcaagatacaattcatgaaaagaccgaatatgaaaaaatctccatctaattcaaaataagttatctatttataaaaccacaaaaacctcagcacacacgcacctctacaatttgactcagcaattacaattctagaaattcagtctataaatatacttgcatatataagtaaccttgaaagtaatacatggtttccatttttgttaaatcttaactagtgataaaattaaggttttgtgtgcttcttgtaattaactacatagcttattactgagttaataaatgtttattgagagctcactatgtgcaaggcactataataaatgctgggtatgcaataatgaacaaaacagtccctaccttcaccaatctacaataaaggaaaagataattactatggtttgaacattccctccaaaattcatgttgaaatttaatccccaaagtaacagtattgagaggtggggcctttggaggtgactggatcatgaaggccctaccctcatgaatagactaatccattcatggatagtggattaatgggttatcatggaaggggaactgatggctttgtaagaagagaaaaacctgagatagcacatcagcatgctcagccccctcaccacatataccctgcatcacctcgggactcttcagagagtccccactgcaagaaggctctcaccagatatgccctcttaaacctggacttcctgcaccccataactgtaagaaataaattttgttttttataaattacccagcttctgatattatgttaaaaacaacagaaaacagcctaagacgataataaacctctaaataagttttatatacacacaaacattcatatcagttagcatttctgacaacacagtaattcatatttttacataaaattatctctaagtttcgcaaatgtgttaatatataat

SEQ ID NO: 1685 - DNA, 34757 bp, Homo sapiens
gggagaacaaacttaacatgacttacatcctcatttagcctttaaaattctctttgtccacaaacctccttgtttctggagttggcaacatactgaaatagaatatatacaaacttggaaacagctatgagcttgacctaaaaccttaactctgaccctttactgggaaggctttggtaggtgatacatcctctgtaatattttatcttctacatcaaaaaagtccttcattgtacagaattttgagagaaattaatgagacaatgtctcatagcacctgaaacaacgggttctcaagaaatactatttcattgattactcctcactttcttaactcttaccagacctattttgagtctgtatccttggtatcatcattttttctcaaattatttctaaggcagcattggtttgtgttataatcattaatagatacctgaattaagtgaaatatttcaaagtaaagccatatagtatcctgtggggaaaagcctatcttttgagccagaaagactggcttaaatcccagtattattgttcacctctttgtgggttttgtttatatgtttatacacattagttttaccatctgcaaaatggggataacagttttcacccttattcgtttcctgttactatttcccaaattgtcacaagcttagtgacttaaaacaacagaaattgcccaggtatggtggctcacatgtgtaattctaatattttggaaggctgaggtgggagaatcgcttgagaccaggagtttgagatgagcttgggcaacatggcaagaccccatctctacaaaaattaactagtcatggcggcacatgcctgtggtctcaggagggtgaggtagaaggatgacttgggtccaggagtttgacgctacagtgagccatgattgtaccactgcattctaacctgtgcatcagagcaagagcttgtctcaaaaacaaacaaaaacagaagttggtcatctcatagttgtagagatcagaagtctgcagtgtgtctcactggactaaaatcatggtgccagcagggctgtttttttcttgagcctgtagaggagatcttttttcttgcccttcccaacttttagaatccactctgctcccttgggtcacagccttttccaagttcaaagccagccatggccaggcaagcctttcttccatcaggtcactctgacctgacccttctgtctccctctcccatatttgaagacccttgtgattacctggagcccatcttgatgatcctgaataatttccctatttaaggtctgctaatcagcaaccttgattcccttttaccatgtcatatgatacattcgcaggctccaggacagacatggacatctttaggggccacaattctgccttccacagccactttatagatggttgttgggattactgggaagatgtagtaaagttcttagcacagtggctgggtatggagtgtagtatgttctgtagatggagaggttgacgtggaaaatgattttcttttttctcttttttatttttattttttgagacagggtctcactctgttgtccaggctggagtgcagtagtgcagtctcagctcactgcaatctcctctgcctcccaggctcaatcctcccacctcagcctcccgagtaactgggacaacaggtgcatgccaccacacttggctaatttttgtattttttgtaacaacggggtttcactacattgcccaggctggtatgatttttctaaaatcaaggcatttccttaatttaaaaaaaaatttgtttatttctttactggattagctgtttgggggaatcctgaagttaaccctatgtaaagattcacccagatggttcagtgtttccttcatagataaccccctttaaaaacactagcaatgggtcaggcatggtgaatcaggcctgtaatgctagcactttgggaggccgaggcaggcaaattacaaggtcaaaaggtcaagaccatcctggccaacatggtgaaaccccatctttagtaaatatatgaaaaatagctgggtgtggtggtgcgcacctgtagtcccagctacttgggaggctgaggcacgagacttgcttgaacccaggaggtggaggttgccgtgagccgagatcacgccattgcactccaggcctggcagtagtgtgaggctctgacacaaaacaaaacaaaacaaaacaaaacaaaacaaaacaaaaacccactaacaatgatgatgtgggggaaaatggccagacagaaataaaataagaacggaggtagatgacattcaaagtgtgtttcatggacctcacgttgattctcaaagcctgaagctcttcggtgtgcattagactaaattatcattctgctgagagtgcatctatgttttcttttccactgtttgtttttaaatgttgtaaaaacaataataaagtatggcattattagtaagcatgaattatggaagaaactcatctggaccagggaaacattgacattcttatttttttagaggaagacagagtatcccactatcacccaggctggagtgcagtggtgcaatcatggctcactgcagcatcaaccttgccggctcaagtgatcctcccacttcagcctccagagtagctggaatcacaggtgcatgccaccacactcagctgatttttttgtactttttgtagagatgaggactccctttgttgctaagactgctctcaaaatcctggtctcacaggatcctcccaccttagcctcccgaaatgctgggattaccggtgtaaactactacaccccacccgatcaacattatcctgattatacattaactcaggtgagcttcatatatgtgaagaaacactgaaagatcagattgcgaagtggtcttgttactcagcagcttccgccaaacaatcactaccatgataacatcaccaacaaaatgtctgtgactttcacatcccctgctttgagaagtagaaataaaaatgttctgggcatacataccacttatgaattgactgccaaactgttcttttaaaagtaggtcatttgatatgcctgttccactgataacatatcttaatatatagtagaccataaaatgtggaagatcataatatacaatctgcattcacttagcagcaactttttccttagctggagcacagatatacttaataccaaattagaagaaagtgtatgttattgtggaaataagattttaccattaaggcctaagaagcaaaagcaggaaaccaacaggaacccataaatggttggagatgacaaagtggactgtaatagtctttgtgtagttatttttttgagggggaggggacgaagtctctctgtcacccaggctggagtataatggtgcaatctaggatcactgcaacctccggctcccaggttcaagcaattctcctgcctcagcctcccaaatagctgagaatacaggcgcacaccaccacgcctggctaatttttgtatttttagtagagacagggttttgccatgttggccaggctgatctcaaactcctgacctcaggtgatccatctgcctcagcctcccaaagtgctgggatgtcaggcgtgagccactgtgcctggccgtcttcatctgcttttacatgatgcttcctgtttccctcggagaggtctccttggatgctctttgcccccgtgtgattctggtactcatacaacttgacatttcttctcatcacatgagactccacagtgagcatggtttttcctatccgtgttccgctgttcaaggaaactgcctgcagatgctcagagctttctttctcctttctttgtgctttatcagagcaaggatgattccggcttaccttgtccgtggcttctggatattttcacccagtagagggcgtgagtggaaactctgaatgcaggagaagccagaactcatcttccccttctctctctgcttcccaaggcaccctgagtcctccctcagggccctcctccaaggccctgtctcccgctgggcagtgtccaccatggcacgtgaccctggtttctggtctctgaagacacctcctcttcccattggttgcaagggttttggtagcttctgcagtcacctcttcctcaattctgttaccgttccttctttggcctctcagatctcccgagtccccttgatgaaaaaattccttttggttgaaaagtcccggaatagttcctgtttcttgcattattctaatatatttacgtctaaaacaaccctcccctcttgcatatggtacatgatgcatctagggattatccctggtaagaatttgctcatcttttattttctgtttgtttaattattttgaaggaattttagactcagggtaagtttagctttatagagagtcctagtatactcttgaccaatattcccctaaatgttaaaattttgcatgatcacaacacatttctcaaaactaagaaaccaactttgggatgatattacaaactaaactgcaggcatacgtttttaataaaaccaacattgccactgcttttaaaagtagtaaataaaaacacatatcatgtatgcatatgtgtgtatgtgcagatctctaattacgtatattgacttatttaagtttcacgtgtacttacagcacaaactacttttacaaggcagttggaattggatggtgagcttgccatgaggctagagccattcatttcccagatgttaaaaacatttgtttggcccgggtgtagttggtcacacctgtaatcccagcactttggaaggccgaggcaggtggatgacttgaggtcaggagttcaagatcagcctggccaacatgacaaaacccctcctctactaaaaatacaaaaattagccgggtgtggtggtcggtgtctgcaatcccagctactcaggaggctgaggcaggagaattacttgaacctaggaggtggagactgcagtgagccaagatcatgccactgcactccagcctgggagacagtgagactctctctcaaaaaaaaaaaaaaaataataataataatatttgtttgttccagagggctgtttccttaaaactgaaagtgaagattaccaaattcagtttgacaaacaaagcccccgtacagttcacgtgccaagtgagagaaggcaggtgccagtcccagcatgtgtgtgtgtgtgtgtgtgtgtgtgtgtgtgtgtgtgtgagtgtgtgtgtgtgttttggaattcacaggataaatactgtggtacaggaactgtcaggcctgattaatacttttgcactcgcggtgcatgtgccttgatctataggcattatgcttgctgcgtgggtccctcacaaggcagccattagcatcagcttccaagcagctcccccactgtgcacttcccttccctgtcatatgcttggctgtcatctttgctaaaggattttcaggttggtttgcaataagggtaaacttgggaaggatggagagcaatttcctttgaatgctcaggatggtgggggctggttcttagcacacagaaaatccatatgagaatgcctaggacaaagcgggggaatgatttctgtatacggtgtggtgtttagtacgtgaaacccttaggcccccttaaagtcttccgctccaacccttaaacagttaagcatatagattagcatcacttacatgcaaggacattgtaaaatatgatatgtttacaaaatgctatggaacgctagatgattattaaacataatgaggttgaaatctaattccataatatgaagatgcccatgttttattcagtagaataagcaacttgtagagtaacataagtagtgtgttatctcattttttaaaaaaggtagataagtaccaaggagggcagatcactcgaggccaagcgtttgagaccggcctggccaacatggcgaaaccccatctctactacaaatataaaaaattagccgggtgtggtggtgtgtgcctgtaatcccagctacctgggaggctgagggaggagaatcacttgaatctgggaggcagaggttgcagtgagctgagattgtgccactgcactccagcctgggcgacagagtgtgactcagtctccaaaaaggaaaaagaaaaaagaagatagattcagatactgcaataatttggaagctttatacagcaattactaaccagagtttttcttttgtaagtgagtttaggtgaaactttccctttctacattgtaagttgctttattgtttgtagattttataacgaataggtaatatttttggaattcccaaaaaatattgaatttcccatgtaagataatattttctacagatcatatcattcagatcttgtttcttctaagtaatgaaattctgatgcatttcatactgcctgctgcaagtaaggatgtctgaaatggacaataataaactaaagatagaaagaatcccttctgagtcttacactggatggacttcctgccctccagccatctttaaatatcatgccaggtatgaagaattaacatccctgatttttcttttagaaagaatattggtatctgcctagaaagaagatggttattaaaaagaataaaagcagacctgctttttcctgcccagttaatctttaccgggacaggacaaaccaatcactgcggaatgttttgtgggtgtcctgaggctgctgtaactgagtatcacagactggacgacttagaacatcagaaatgtcttcgcctagttctggaggttgcatgtctgaaatcaaagtgtgggcaggcttggttccttctgcaggatctgaggaagtagcctctttccttactcctagtgatttgccccacagtctttggtgttcctcggcttatgggtctatcactccagtctctggctttatcttcgtgtggcattttccatctgtctctgacttcacatggccattttatttatgaggacatcagtcatattgacctagggactcaccctactccagggttacctcatcttaactaatcacttctattaataaagtgactctgtgtttgaaaatgtttgcatttggaggtatccggggttaggacttcaccgtatctttttgttgctaacagacactttaaaaatatagatgactgcatcccaattaccagtcgaattgttttgggcattatttattaagagaaataaccattgtgatgcataagatgatctgtgagccctgtgctgcagacgagggccatgtggatggtatcgtgaaaacagttgcacctttgcttaaggcaaactcattgtataaaatacagtttgcaaaacagttattttgtgggtggcctatttttccctctagaaatggcattttttactctataaaggaatgaaaacttcttatacagagaacttcccagtggatttagactagaatctcattcactggtgctaataattccaaaatacattcgtatttaagatcctcatgccagtaattctagtactttgggaggccaaggcgggtggatcacctgaggtcaggagttggagaccagcctggccaacatgccaaaaccccgtctctactaaaaatacaaaaattagctgggtgtgctggtgggtgcctgtaatcccaactacttgggaggctgaggcagaagaattgcttgaacccaaggggcagaggttgcagtgagccaagatcgcaccacatctctccatcctgggagaaagagcgaatctccatctaaaaaaaaaaaaaaatcctctgtcccaataaatatggccacaggaaaattcctcatttcctcaaaataaagaacttctttcacatgaaatgtccatgtgctttccatcagcctttccctctccaggagaacatcaatgcaaacacttgtatttccctcctttgaaagtctctctatatagcttccgtcttttctcatgcacgtgagaagtcagctctgccattaacagcagatggatggagacacagccgcatttcccttctcacaggcactgtctgcttggcacgtggaactgcgtttccttgctcgcgaatcctcatgtgatacgcatctccccatccctcataacctccctcggtgcagaaactatctgtgaacagtggtaccggtcccttgacgttgtagcttgacttgctgaactctgattctgaatccatatatagacgcagggacactgcccagttttgcgtttaggaaagtcagactgtcatcggtgtggagggctgtgcagcagatgaggacagggccccaatcccaaactgaagaatcttttataggaagtgtcaggcctttttgcaggagcaaatttttcatcattgtatgtgtatttaacttttctgttctttggtaactggataaacagtgaataataaatgaatgtctgtgctcatattctcctgtcctttaaaaattatattaacttatttttaatcagtttattagttatatgctatattacatgctataatctgtagagaaatccacccccaaccgtgcccagtgatagtgactcaaatacagtaaaaatgtttggtttttttttttttggccaggcgtgatggctcacgcctgtaatcccaacacttcaggaggccgaggcgggtggatcacgaggtcaggagatcgagaccatcctggctaacaaggtgaaaccccgactctactaaaaatacaaaaaattagccaggcatggtggcgggcgtctgtagtcccaggtactcaggaggctgaggcaggagaatagcatgaacctggaggcggagcttgcagtgagccgagatcgtgccactgcactccagcctgggcgacagagcaagactcaggtgatctacctgcctctgcctcccaaagttctgggattgcaggcatgagccaccatgcccggcaataagttttcttaattcattgcaaaaggcagggcttttctgacaagagtgagctacagccattattctgattaatgctgccataatctaacatcacggaatggcaaactagagactatgggccacctctagcctctgtctgtttatgtaaattaagttttattggaacacagtcatgctcatttgtttacatattgtctctggttggcttcctgccacgacagcagagttttgcaacagagaccttatgtcctggctttgaagatacatactatctgcttctttgtaggaaaagtttgttgattaccggtatacagtgttgatctttgagcagggtacttaagaacgtagaggtgctttggcccaccacgaagagttttggaagacgtaagacttaagtggtacaaggagaggtcctccatccctgactataagcacttgtccaccttgatctcatctgtatagggttcagtgaaacttctgcttggaaaaatacatgtttgaaatcaattacatgaagcaaatattgtctagagtgtgaaggaaagggaacctgatcttcctgcttggaggtctacaaagcctcaaaaacagataggcagttgcccttaacctatacagcagagacattgtgtatctaaaggcatggatgtccagctaggaattatgacactcatgcagagggacatgaggagggggtagtttgggtctgactctccagttcacttctcatggatgtaattgatttcaaacttgtatttttcctagcagaagtttcactggaccctatagagatgagatcaagatggccatgtggttatagacagggctggaggacctttcctcctaccacttacatgtgggggttccaaagatttactaaatgctttgcatgtgttccaggtgtcagagcccatcacaggcagggttttgactctcagggagcctgcagtcttgtggagggaaggtgggcaataaggaagaagagacagcatagatattttgtgcaatttcagccagaggaaatatggcaagacagtagacagtgggggataaagtacagcaattttcttttatttaggaagattagagaattcctccttgaggaagtgatgtgagtttcaataaggatggaaagtaccatggaggtctagaagtgtctgggggcaggggtaacagcaaaaacaaaacttttcaaacatggaggtggtgttggtgcatgctggtgtcttgcaagtgctttcagaaggctacccttatcttttcctatccacctggcaaatacctcctcatatgcatgcaagactttgctcaaatgcagcaatccttgtgtttgtttctgctgctctaggcgggaatcccatcccctttcttccaccttatcctaaccgtcagtgctcccagtgttacagggacatgaggaggggttagtttgggtctgactctccagttcacctcccagcaccctgcctagtggtctacccatcactgatacttaacagttattgaatatgattatgtgtataccctagaaaaataagcaacaaaaccgttcattgtaatagatgacattgactgaacacttacttaaaacgcagtttcaagcccttagcatatataaagccattcagtatgccaaataaccataaaaggtagggactgtcattatttatagaagaagacactgaaacacaggaagactagtgtgtcagaagtcctacattctgataatagtagcacacacttcctgatgttcattatacatttaccactaggcgtttaatgtggattttgcttataatcctcataaaagtctctggaacaaatgctgacatgatactcgtttcgaggaggagagaatcagaatacagaaaggtaaaatcacttctccaaggttacgtggctagtgcgtgagagaactggctttcaaattcacatcactttaatgtgatgtgttggtattagaaagggaaagcatttcaaaagccctcaccacagtgtcataaagctggctgctcatggtaaacattccaaagaatccaccaacacagtgtccttggagtccgtctgcgtgcctgtgcaactgcaccttgcttctcttggtgaaaaattcacctctttggaccctgtgttcactcttgttgttgtcctccccttagatgaggaaggagcagggccatccgtaaaaacagagtcatagggtgaaaacacatcacagagaatgcaaaagggttatttatagtccagagtgggaagctgaaaagacactgtgagaggaacttaatcgtttcccaggggatcagggagaagagtggacagtggtgatgccacgctgcagagggtcaaggttgcataccaattaaaatgacttccagacacttaacacacacatggtacttcgctacagaccgctgacatgttccagccaggaaggagaaaaaaaaaaacaacttctgatgtctcatgcctctgtcccccccttaaacagtgaggcagctgggctaacactgttgttgccaaacaactctaataatttcaggttccatgataatgagttggtggccttataactctcgtttgcatatcttggtacaagggaaaacattcagtccagtatgactctttaaatagccatctatgccaagccccacataaaaggtgggagggcttgttgatgttccctttttctgcaaactcatttgtgaaactacatcaattacagttcaatcagttctcccattcttttttcttctcattaaacttatgcctttctgcttagttaggagaggactgtaaactcagcttaagcaaaaataagaaaaataagaaggacttattcattctcatgaaacctatgcgtctaagggtaggagactgcctttttggtgtgcgtaaacctgtgcccctgagaaactctctgcttctcaaaactgctttcatctttgttggtttcctttttttttttttttttttttaataactttcattttaaactcaaggttacaaatgtactgtttttacataggtaaacctgtgtcatggggacttgttgtacagatgatttcatcatccagatggtaatcctagtacccattagttatttttcctgattgtctccctcctcccaccctccaccctacaataggccgcagtttgtgttgttcccctctgtgtgtccacgtgttctcatggtttaagtcccagttttaagtgagaacaaggaatatttgattttctgttcctgcgttagtttgctaagtgtaatggcctccacttccatccatgttcctgcaaaggacataatcttattctttcttatggctgcatagcattccatggtgcatatggaccacattttctttatccagtctatcattggtaggcatttaggttaaactgaaatcataacaaacagtctcttgcaccacagcataactaaattcaaaatcagtcagaattcactcaaaaccatacagttacatggaaattgaataacctgttcctagatgacttctgggtcaataatgaaattaaggcagaaatcaagaagttctttgaaactaatgagaacaaagataaaatataccagaatctctgagacgcagctaaggcagtgttaagagggaaatgtatagcactaaatgcccacatccaaaagttagaaagatctcaaggtaacaagttaacaacacaattaaaagaactggagaaacaagagcaaacaaatcccaaagctagcagaagacaggaaataaccaaaatcggagctgaactgaaagagatagacacgaaaaaccattcaaaagatcaatgaatccgggagctatttttttttaaacaacaacaataacaacaacaaaacaaacgattagctagatgaataaagaagaaaaggtagaagattcaagtaaacataatcagaaatgacaagggggaatattacccctgggcccacagaaatacaaacaaccatcacaagattatgaaaccctctctgcacataaactagaaactctgaaagaaatggataaattcctggacgcatagatcctccccagactgatttacaggaagaaatttgttttactttcaagcacgttctcatattgtcaccaaagctccacacttaaaatcccttgtattagtttgataggactgccttaacaaattaccacaaactggtggcttaaaacaacaaaattttattctctcacaatttgagaaggcagaagtctgaaatcaggatgtcagcagggttgattcctactagaggcttggaaggagaatctgatccttgcatctcttttagctccaggggactgccagcaatccttggcttatagccacatcatttcaatctctgcctctgttgtcacatggctgtattgtctgggtgtctctgtattttaaatctccctctcctttctcttataaaaacactagtcaggccgggcgcggtggctcacgcctgtattcccagcacattgggaggcctaggccggcggatcacaaggtcaggagatggagagtatcttggctaacacggtgaaaccccgtctgtactaaaaatacaaaaaaaaattagccaggtgtggtggcaggcgcctgtagtcccagctactcgggaggctgaggcaggagaatggcgtgaacccgggaggcggagcttgcagtgaaccaagattgcgccactgcgctccagcctgggtgacagagccagactctgtctcaaaacaaacaaacaacaacaacaacaacaaaacagtagtcattagtgtcaggctgtaccctaaatcaaaaatctcaagaggcttaattacatcggcaaagccccttttttccaaataaggtcacattctcaggtaccagggactaggaagtgggcatatcttttcgggggcacattgtaattgactacacatattactgtatcaaccccattgcaaacagagcaaaccccagaaatactgggctaatgctcgttagctctgatcacctggcctgactcacagatcaacctttaggctaatcactgcagctagaaggacatgtggcaaccccagataaagaacataccatttaaagaccacacacatcacacaaaacctattgagagacgcttgacgaacaaggtttgtgctcagtgtgttaagtggatgacatgatttaaaaaaaaagtaactgaagagctaagagagagttatggtggaagaagtcgttacacaaaggtgctacataattgctgctaggttcgtgttagccaaaggggcttacaccattttcaagcctttacaagacctgagagtgatgtgttggtttgagttggtgtttatgtggaaagggaatatgtatggaatattattaaatagttttactgaattattggcatattgtaggcattccttaagtactttattgaatgatagcacaaaatattgctgaatatttttgctacattcttggcaggttgtaggcatctcttaagtatagttctgcaccacataatgacgtttcagtcaacagcagactacatatatgactgtggtcctataagattataatggaattgccctatacagatgtataattttttatcttttatatttttatcgtaccttttctatgtatagatagatttagatacgtagtacttaccttttaatgacagttgcctacagtattcagtacagtaacaagctgtacaggcttgtagtctaggagcaataggctagaccatatagagtgtgtgtgtgtagtaggctacaccatctaggtttgtataactgcaccgtgtgatgttgtcacaaggatgaaatcacctaacgatgcatttcttagaatgtatcctgactcttaaagcaacatttgtggtttattgactgaagggataaaaaataaataaatgaatatatgaatacaaaacaatttttagaagataaatgaatgagtgagcaatttgtccttctctttcctcctgagattttctatttttaaaagtgtgcttgtatttttgtctttatatttaaataatgatttaaatgatttatttaatactgaagccactgatgagctgagaactcataacacattgctaggcacagagcaaatgtgaaatttagtttttgttgtttttatccacatgttgttctgccaagttgggcaacataatgccccctcagaatgctagttaatgcacttaattctctcagggtcttcttactttagactctttgacatccttgggcaattaaagattagctattttaatgaacacaccacatcttttacaaagcctctttggcaaaagacctttgtcagtccgccatcgacatatattgcaaattacctgctgtgtcccttgaagtattatggaaacgggaaacatatgggtggactggcacaggctctgcataccccattccagaagcttacattgtagtaaggcaatatcaaaacatgcatgcaaatgaattaggttagtcaatttgagattatctgggagggggctgcttttgtgcacaagacagagctaacctggaatttgaaaggtgcagttgggcttagctgtttcagtgacagtggggagcagagatgctgagaagggcctgagaaggacagtgaaacccaaatgacagctcaagtgttctgattgtcactttcatgcaacccctggtactgagtccatgctgcatattgttaggtgaaaattctttttttttttttattatactttaagttttagggtacatgtgcacaatgtgcaggttagttacatatgcatacgtttgccatgttggtgtgctgcactcattaactcgtcatttaacattaggtatatctcctaatgctatccctccccctgccccacaccccacaacaggccccggtgtctaatgttccccttcctgtgtccatgtgttctcatcgttcagttctcacctatgagtgagaacatgcggtgtttggttttttgtccttgcgatagtttgctgagaatgatggtttccagcttcatccatgtccctacaaaggatatgaactcatccttttttatggctgcatagtattctatggtgtatatgtgccacattttcttaatccagtctatcattgttggacatttgggttggttccaagtctttgctattgtgaatagtgccgcaataaacatgtgtgcatgtgtctttatagcagcatgatttataatcctttgggtatatacccagtagtgggattgctgggtcaaatggtatttctagttctagatccctgaggagtcgccacactgacttccacaatggttgaactagtttacagtccctgttaggtgaaaattctatggtccatttcacaactacgtaccacagaaaagggagatacggacaacactggaaaaacaaaatataagtatgcaaaggaacacagacttggatatgaggaaggggcataaatgctatatttaagcacatggttactgcctttcctaaggagtaagccaggaaaagaaactttgggtcagttaaatatctcgttgcttcctttgcaaaagtaccttttaatagtctgtttttagagttgtttaaaaagaaaaaactgtcccttgcctactttaaattcttgacatttttttctggttttggtgagatcagggtttttgcagggcagtatccttcattatatatgtcagaaggctgagaaatgagtggggatggtgaatcaaccacagcccttctgaatttctcacaaggtaatctacctaacagaacataccagtttccacccacctttgttttggttagagtgatattttgtcccttggcagtgaggacgtctttccttcacatgatttttgtaagactgtaccctaaaagtagccacagtgcagctgtgttttatatgaaaacaaatggggttttgttgggtacattttgtggcatttcttgaggtcaccagaaactcctagacgtcgttgtaaaacaaagaaagaagaagaaaaaggctggaaactcactcctcctgctgttcttatgtcaagtcagtgaaggcaattctttaattttttcattttttcagtgaatacttagcacataccatgtataaccccccatgtaagaccagccctttgtcttctaagaaatgacattctgggctggacgcggttgctcacgcctgtaatcccagcactttggtcgaggtcgaggcaggtggatcacttgaggtcaggagtttgagaccagcctggccaacatggtgaaaccccatctctactaaaaatacaaaaattagctgggtgtggtgtcgcaggcttataatcccagctgtttgggaggctgaggctagagaatctctttaacctgggaggcaaaagttgcagtgagtcaagatcgtgccattgcactccatcctcggccaccaaccctatctaaaaaaaaaaaaaaaaaaaaaaaaaaaaggtattctggtggatagtgggggagtggcacacccccaaaacaatttcacaaacaattatttaattgcagttgagttaagtgctaaagtgagaaggacacagaatagagtcgatttaaattagaaagaactaaaaaatgtagctaatttcttcattcctgtaactctgggtttgagacaacaacaatttgagtgaatcagtgaatgactgcatagatggcatgtataggtgtcaagtaaaaatcgtcttgtagctaaatcctcagttgtgaaatgggatacaaagtccaagctcctttccttttctaggtatttctgatgggattcactcagttcgttaaaactttaagaaagccctctctgtctgttatttttctctctgcctactcagatggttcctccattctaactatggtagaggccaaccttgtcatgattttcagaactatgtagttccccaccgcccccgccccaagaaatgcagagcaatctgccttatcagtatctcttccaattaatgtaatcttgtttctgttatttccaccatatttttcaatccagtgagcctcattacatttgcaagtgcattaaattagagcctctatagaaggagaatgatgattatcagctaatttaattatgtttctacatttgcagcatttaatgatgtctgccattgttgttggggattcttacattggctccaggtagaaattagctctgatcccatgtaaagtttacgttatcagataatacttgagagctcattgaggtacatgttcagtaatttttgaatctaatcaaaattgatttatgtgcaatcaaattataggaataaagaaacagcttcacctaatttagttgccgattatagtgttgcctgcctctgaagtcacaccaatatgcgtctcttagttttgtaccaacattgcatcaaggcctaaaattctgcaggtttttttttttttttttcccaaattgcatagttggttctgtatttctgaccttctgctgtccatcagattgaacatttatgccctctgattttgtgtcctgttcaacaaatgttgcccgggtgtcctttaagtgttggccatgtgactcttgcactagaggcccaggtcacccatgaacctagaagagaagatccatggtgtggaggagtgggtgttgcaggacctgggagctgaggctcgggagggctgattcatcattcttcctcctttgctgtggattctcaaccaaggcaaaaatagatacacacactcaacagggattaaggtacagaattcacgctgggcatggtggcttatgcctgtaatcccagcactttgggaggccgaggcaggcggatcacctgggatcaggagttcgagaccagcctggccaacatggtgaaaccctgtctctactaaaaatacagaaattagctaggtatggtggtgcgcacctgtaatcgcaggtactcaggaggctgaggcaggagaattgcttgaacccgggagacagaggttgcagtgagccaagattgcaccacagcaccccagcctggatgacagagtgagactccatcttaataaataaataaaataaaataaaatagaaataaaataaagtatagaattcagtttatcaccagtgaggctgtgttgtaaacatgcttttatgtttaacaagcactttagtcatagttattttgtgccagacacaaattggaaggaccttatacacaaaggccctttgaattgttatgatagcctaaatacaaactattattatcctccatgcacagtttatagacgaagaaactgaggcacagaaggctgggctatgttgccgaaggctacccatctgccttctgaaagaaccagggttctagtcctggcggtctggctctaaaatccatggccgctgaacacaaagtcctattgtgcctcccaaagctgaaattagcattctgtcatccaacccgcattactcctacaaccatatctagatcttgggatgggcagagtagtttggaggatattggtccagcacaggggaatgagatggggctttgaagctggcctctagaaggcggggccctgaaacgtccctacttaggtgtgcttacctgttctaggtataccttacctactctaggtgagcttaggacatacggatcaaaagcaaaacatgcactgcttggaggaagtgagacagagaaagagagatggagagaaagaaaaacttttccattttgaaaagttacccatcagaaaagtctctatgatgttgattgggtgaggaagaatattggaaacttgctccctgaaacagtcataacacagtggaggatttgagtaagtctctaggtctcaaaggaggaagcaggaaggatgagaagataagaactatgaacgctagactgagaatatactattaacgcctatacttaagaatataagatgttcttgagacatgtgataaagtaactttccagaaaaatgagcagcacactgtgaaaacaaagacgcaaaagtgaggtgtcagtcatcccccctctgaggccggagggagggtggagatttggtgcaggtcgaaactgaagccaattgataaaatgctgtgtgtgccctacaaggaagagagaaggtttgaataaaataaagtgtgtctcagtacaaaaggagaagtttcacaaagcatttagacatcttataaaatggagttgcttcatcactccctaaaggggccatcctcaactgtctcctgttcaaggcccactctcagcctcgctggatgtcaacagccataaccatgtgattgttactgcagcagagcaatgtctccaagtgtgcaaaggacatctctgggtcactgagcgtgaatgtccatgagcccagccaggctcccttctctgttcaggaggcaaagtttttccacttcgcagtccccaagatgtctctgtgatactggtatggcgttaccttctgcctcttcctgcttacgggtaccttggtcatctcaccagtctccctgggggttagcatcttaggaatgtgtactcaatgacagccaacgtaaattttgcaccttgctcaaaatttgactgctttcccgttaacggttcattaattgaaaactaccggtatcttcctaaacctagagtatgtcccaacagcaggatgtgattttatgttttgtggtacatggacatgcattttgttgtaattgcagatgtatatgtatgaggctggttttcaaatatagaaaatatgaaagaatcataatatactatatacccagcattaagatgttacaattcacatttttatcatatttgttttatctcttatatatccatcacttcatctaccaatccacctcattttgtttttttatgcatttcaaagtgacttgcatcagtatctttcacccttcagcagggtgtaaatctttaatgagagctcatggtttgtttgtggtcttttatttttctgaggtaaaatttattgatactgaaatatacaaaccttgaagggaccgtttgatgaggtttgacagctgagtacacttttgtaacacgaagctctgtgaagatatagaactgtcattcttccaaagtttaggtatgatctgtatgtttattagaaaaagaatcacagcctgaccagtatggtgaaaccccgtgtctactgaaaatacaaaaaattagccaggtgtggtggcatgcgtctgtagtcccagctactagggaggctgagacaggagaattgcttgaacccaggctgcggaggttacagtgagccgagattgcaccactgcactgcagcctgggtgacagagtaagactccatctcaaaaaagaaaaagaatcagcatacatactaaacctatgattccatgaacagtttaaatgaaagagtacatacttttgtgtgtgtatatgtgtacctggttacatatatgtgtgtataatttacattgataagaataatgcagtatgcagatgtagcagaatttgtaattgtgatggaagttcttctgtatttggcaattacaggcctagggaaaaggtaacctcatcccattagcattgtcttcaaaaagaacacgagcatataaaatgtgcgaggctacactgatgtaacgtccaagataaatggaaagaaacacagtgttgctcgtttaattgaggatgtttaacgacttttggccctgagagtaccaacagctacaatttttcaaagtcagccttgatttatgttttattttttaagtactcattaatgtcacaaatagttaagttgggatcagctgtcttcatttacaaaaaatgggttatactttcatcttttgaccctgaaacgtgtagataaaaatcaacattaattggcaggatgaatgagggtggttagggtgggtgtctggctgcaagattcttagagtattgggagagatgctcagagccccttaactggagatgacaacgagattttaattaacagcaggtgagtcttgtggtcagccatttgacatataggtggatcacaaaatagcctttcctttctaaccacatttatttctagcttaattagtccttctgagatagcttcgctattagccacagcctctccatttaagatccttttaatcagacgttttatttttttattttttattcttctcattttagcactagcttaatgttatgaaggacctggactaactcattttaatgacctctgctacataaatgctaattttacatttggccttatttcggtaggttttttttttttttaaaaaaaaaaaagaccattgctttcagaaggagaaaaatggaaagattaaaccccttagtgtcatctgcctgaaaaatcctgtggtttcttctgacaggaagagggttttcaaatccctccttggtctaagcttctgtgcttgacatctcattattttactcagctacttcagcatcaccttcacccagttaattaagtaactcattgaatgtattattcagttttgattcccctgtctgtgacagagagggatggaagatgcttcttcatccttcttctcctgcctttttctcttctgcccacacccaaggaatggaaaagagaaaggagaggagagaagacattaatttcaaaatccatccatccatccatgcatccatccatttctgcagcagattgtttgatgtttttaatgatactcaaaagaaagtgaagttgatgatggtaaggttaatggtcataggtcttaatggtgatataacatcagtttgcaccaggcactgttaaaatttccttctaacatggtcttatttcgtacttaaaacagcctgatgaggtaagcactattcataaggccactttacaggttaagaaagctaagatctagtcaactaatttgttcaagtctccttgctagtaggaatcagaaacccaatttgggcccagaactagctgattggtaatacttatattccctacagcatttctgttaagtatctccatgtttgtagtcaagtttaaattcctaaaatttaagctggaatttatgatgaaaataccatgagaaggaggttgaaattgtagttgacctatgttacccgacctgctcgttacaggagttaagaaagaaacttgacttcctctagggcagtagtcctcaaaccccaaggaccaggacatttggccaaacagctatgataaatgctgctttatttgagtacattagacttcaattaaaaaaatgttttaaagtaccttattgaatgcatttagatttgggggagggaaggaggctatacttggacctaactccttggttgtcaacccagctggaaataagcaagacatgatgtttaatatgaatgaaagtagagagagagggcatttggaggggggttggtgcagagggaagcagaaagaattactaacatgaaaaggcagatagaaaatttagaaggtcaaaggcagagtaattgaaatagagcctcggaaattgtgaatctgagaaagaactggaggttaagtgataggtaagaaggaagataaggacaagtaaagggatggaataaaaccaaaaatggggggtgagtgtgtgtgtgtgtacgagagacagagatgcattttaatgcatatttaagaaaaaggaaagtagaaccttataaagaagatgaagtagaaatattttttagaaaacactttttattatgaaacatatttttttttttgtaagggaaagttcccagtgacagagtgagctgtgtagcaacgtgtgtaaaaagcagacatcacattcttaaagttactccattcgctcctgaacaaatattaagtggaggttttgttctgggtgtcagaatacagcatggaaaaaagacaaaggaaagtctctgctttcatggagctaagaagctagttgatgtggagatagaaaaataaacaaggaaatcaaggttatcaatgcaaataatggtacgtgcaataaagaaaacagaacagagaggataaagcattgctggctgggggaagagctcactgatgagctggtgtctgaactgaccttggggtagggaggaggagcagccaccgggaggctcagagcagcagctctgcagggggcgggggtagagcgggtgcatgcaaacaccccaaggtggccacaaacttaatgcatttgagaagctgtaagaaggtcattgtagccaaagaggagtgagcaggaaaaggtaggagaggtcagtagcgaaatgggcaaagagctatgttgggagctgggtttattctcaatggaaggagaggccattagggtttcaaatagagaaatcacactctatttggataatgtttggataatgtttggacaatgtttagtaaggatgtgctggaaggaggtgctgggtttggtttctgagtctgtcccttgttaattgtgtgtcctggacacagttactgcatctctgtgatccttcacttcctcctccttgaagacacttaactgcatcgggtttctttagaaggaaagctggaagaactttagagtctgttttccctgcatgctagctacaaactgaaaccatcgcaaacaacaaggtcaaaacatctgtgaaaccttgcaccagttgtaataaagatagccagggagaaagaaaaaaaaaaaaggtctgaacttgttggagaaacaaaaggacctcataaacagtatggagaccagttgtgtgttgtcatcagtgacttacctgagaatgatattcctgtggttatgaggatagtgttacagtatttccttggctaagtgtctgtggctgttatccatgtgcagaataaaagtccacttgaggaggagacagaggctcctgtcttttaccaatgttgatggatttcagtggaacaaaaatgagtctcttgaggttagaaggcaggcctggccatgggtgttttgcttgagctattccactcatgacactgggcctgactgatatccggcgaaggccttctttggctgaagtgcttgccaggcctaaccaacctggaatttattgataaagcttaagcagccgcaaggcctatgacctcaaagagtgacttaggctgactttatcagccttggctcttcttttcattatatttgctattactggagctgctctcttttcttaaaacctgttaaccttatacaaggggatgggaccatttgagctctcagacaggatgctgatgggaaattgtaagccttcgaaataggttgagagcttcctgttgtttgggttctggcagaggttacaaaaataaataaataaatataaaaaggagagggatggggagacattgaaaaataaatacttgatgtgttttcctggagttgagctggcttcttcctgggacatgcttttttccagcccttggaagaaagttgcagcgattgtgcccacttcacagatgcagctgacgtgcacccctgtgctgcgtggggatcttagcagggcaggtcagatgtccagaactacttacatcctcacatcagtggcttatagaccaagaaacagtcctctccaataggtgcacagaaagtgttcttgagtctttatttttattttattttttttgagacagagtgtcactcttgtcgcccaggctggaatgcagcggcacgatcttggctcactgcaacctcctcctcccaggttcaagtgattcttgtgcctcagcctcccaagtagctgggactacaggcatgcactaccacacctggctgatttttgcatttattattattattttttttagtagagatgggttttcaccatgttgagccggctgatcttgaatacctggcctcaagtgatccccccacctgggcctcccaatgtgctgggattacaggcctgagacactgcgcctggccacatgttctggagtctttaaatcaacagactgtttaacttggctaaaggaagtcaagtagttacttggtttccagccagttactgatggctgtaattagccacatgttttagtgactttggaatcgaggctctagccaggcgctgtagctcatgcctgtaatccttaggctttgggaggctgaggcaggaagatcacttgagttgaggagtttgagactagcctgggcaacacggaaagatgtatctctataaaaaaataaaaataaattagccatgcatggtggtgcatgcctgtagtcctagcgactcaggaggctgaggtaggtgggaggattgcttgaggccagggggtggaggctaccataagcgatgaccgcactactgctgtccagactggacaacatgagtaagaccccatctcaaagaaatccaggctttgtgtaaaccgatgcatttcttattgaataaacctacacacacacatacacacacacatacacatacacatacacacagactatatctatattctactataccagttattgtgagtaattcatggaggttcagaatgggtagaaaagtcaataaacagtaaagttgccttctgttgtgtgctcattcactcttccattaaaaaatatttctgttactcctttaagaaaatgattagtgcaacaggaaagcagattggctgagtccctcagatcacccgcttctgagtcaaaccaataaggttcatgtcccagatccaacaactgtcagctctgtgaccttgggcaaaaaaccaaacctccgtgagtatgtttactctaaaatagggataatcactgtggctgcctcccgggcttagtgaagttgcatatatatttaatataatagatgatacatacttatataatattatatccatttaatagaatatatgatatatacttttatattttttaatttaaatataaaagtatattacatatttaaagtattcaaatatataatattaatctatgtaatatatgattaaagtattatataaatggaaattacattatataatacaaatatatgtatatatgtaaatatgtacatatataatacaaagatacatatttgtattaaatatataatacaaagatatatttgtattaaatatacaaagatatacatatatttgtactaaatatataatacaaagatatacatatatttgtattatatataatacaaagatatacatatatttgtattatatataatactttaaatttaaattcaaaatatatattataaattaaaaatacacatgtatatattttaatttatataatataatataatttaaattagtaatttagtttataattattacatatattatacatgttttaatttatatataatgtaatataatactttattatgttacacaaattatatatgacatgcatattttaatagtttaaatatatgttatatattttaatttatatatcatatatattatatataaagtattatatgtaagtatacattatgtattatattaaatgtatatgatatgagtataatatattacgaaagttttaatatatattacataatatgtacatatttttaatttaaaatatataatactttcaatttatatattcatcactaaaaatgattttttggaacattagttcttgttgttaaccttgtctctgagtagctgataacttcatgaaaaagtcagatattgtataaaatgccctgtaaatataagtacaagtgaaatcatttccaccatagcccatgatccttatccatgcaggaccaaagacttggtgccacaaggaacagtcaaatctggatggggaggtagaggaggaagtgataacaggtttggtaaacagataattgggcgaacagagggaaagtgattcagcaggaggagacagtgagccaagtttctggaaaataaaaagaggtatcaataaaaaggttgacagggagcatagggtctgggaggaacatactagaatatgagtctaggaaggaaggtggcataggcacagaagtaatttcagtaaatccaatgagtcttacggttttgtgaattcaaaattatttttggaaaatcatgctgcctaagagagatcaatttatttttatttattttacccaacataaactattttgatgcacttgaccagtcagtcttagggtttaggtcactatcatattcacctgaataagtatagtctgactattccttttattcaaaatgttcgagaccagaggtattttggatttcagatttctttttcagattttggaatattgacacatacataatgaggtatcttggggatgggacccaagttgagaaccgtcattgccttatgctttatatgcacatcatacacataacctgaaagtacttgtgtacatgtttaataatttatgcttgaaacagttttgagtgtattttgactgcagtccatcatatggaggtcgggtattgaattttccacttgtggcatcacctcgcatctcagcagtcagacagttttggatttgggggcacttggatttgggattttttcttttttgagatggagtctcgctctgtcgcccaggctggagtgcagaggcacgatctcggctcactgcaagctctgcctcccgggttcatgccattctcctgcctcagcctcccgagtagctgggactagaggcgcctgccaccacacacggctaattttttgtattttcagtagagatggggtttcatggtgttagccaggatggtctcgatctcctgacttcgtgatcagcccggctcggcctcccaaagtgctgggattacaggcgtgagccaccgcacccggctggattttggatttttagattgggagtgctcaacctttaataacaatattaaaaaattattaaacctctaattactgtagcacatatcagaagatttctcttttatttggtttaagttattttggagaaataaaaattgtattttttgtgtgcatgatcttttgaaatgtgtaaacattgcgaaatgcctcaaccgagctacatcacataaacatttatattctatttgattgtgtgaatctcaccaatctggaagtcataaaataagccaattatatataatatagtttatatatataatatataatatatataatatataatatatgttatatataatatataatatataatatatgttatatataatatataatatatataatatataatatatattatatgtttaatatatttatatgtttaaatatatgtataaacatatatgtataaattatgtataaatatacataaaatatacataaaatatgtatattatgtatatttatgtatatgtatcattatgtataaaatatgtataaatatgtgtataaacatttatatggataaattatgtataaacatatttatatgtataaatatgtttaatatatataatacatattaaatatatatattatataatatataaatttatattatatattaaatatataatatacaatatatattatatattatatatattatataatatacaatatatattatatattatatatattatataatatacaatatatattatatattatatatattatataatatacaaatatatattatatattatatataatatataatatacaaatatatattatatattatatatattatataatatacaaatatatattatatattaaatatatataatatataatatacaaatatatattatatattaaatatatatattatataatatataaatatattatataaatatatgtaaatgtatataatatgtattatatattatatataatatcctatatattatatataatattctatatagtatatataatattctgtatagtatatacaatctgcatagtatatataatattctatatagtatatatataatagtctatatatatattagaatgtgcatttaacttgaaaaggttgaaactctaaagtactccccagataactggtggtgaattgggagccagatgatgaagtggcagcagaaagtacagctgaccatgagtacagggtctagaagaatattgtaatacatctacatctcttcaagaacacaacaagttggcgttatttagcaggagggcaggatattccatggtctccaaatcttggaggtcctttctgcactggattacaattctgaaactcatcatccatatttagaaaagtggagacagtgaattacattttacagggattttacccaaaaatggttaaaatgacaaagtctctgtgcttcagtatattagccttcataattttcaacacccaacatttagttttttatctcattcccaggatgacatgtttgactgaagtatctaagacacctttaggggtagactaaacttctgccactctctcccaacaaaatatctgtgtcatatgaatgttgtaggcctgccattgtaaaagagaaagtaatcaagactttaatgggattatttttaattgtcttcttgcatataaaaatgaaatgacaggttctgaaaggaaacttggcatttgggaaagagggtggaaaaaccagacaaatgtaattatcctaaactgttttaaggtacatttttcctatgctcatgtaagaattaaaattagtgttttaaagaataagttactggtaaatcgcatggcaaaagaacatacatgttcattttttcttccttatttcaattttctgagaaaatttaagtagttatttctcaggtgagttttaaaattcatccttagagattggaaactcaagggccacgcattgagacttacacatttattataataaaatatgcttctggcatattaacttttactaccatgttgtcaaacttagaaatattgcagtggaagcaaaaccaagaaaatggctatcggtatgttctttgatgaatgaaggtgtgtacacatagattgaacaaattttttacactaatttatataatgtttagccctttaatgccaaatattacacatttaatgttgtcttattacgagcactcattccggagtacaaaaaattgagaggaaaaacaaaagagacttctcttcgctattgtaactccatgctggtttggttggtgcaggtgtttgggtgatggccaccattttggtcttgtcagttacttaaggctgtagacaataaaggttgcattcctgaaataaagagttggttctctaatcttgtggaaagaaccagtattcattttctaccaggaagcaaaatgccaaggtcacagggacagaaaatattgcttcccaagaaactgtggttgacaagatggctcgagttcaagtgaatcctgaaagtatcagtttccaaggagacctgtggccccacccagccacctacaaagcttagccatcgtttcactcagagcagcagccatttcttgcaaactggcagctcatttctggatactcaataggatgcataagaatgataaatttttttcaaatcatgtgcgctagctctgttgaccttcagctgtgctgcgccttctttaattggcataaatcttggactgcccattggatgtctttctggaatctgatgtctttctgtctatctgattcctaagaggaagtgaaatattcaattaaatagtttcgttgagtccttgtagtgctaggatctttacaagagcggtttagtaggtgttgagatagactatctatcagcttcccttcccaggagaacgtgtcctgttagaaattgcatcttttgtggccagtaggggtctgtttaattgactgaaatagtaatgacccggaggaattaagacagtttttagaaacatcttatattgagaaggaagaacaataactatgataaaattatacaaatacacaataataataaatacacataatttaaagattacaattgtgggccgggcacggtggctcacgcctgtaatcccagcactttgggaggccgaggcgggcggatcacgacgtcaggagattgagaccatcctggctaacatgatgaaaccctgtctctactaaaaatacaaaaccaaattagttggtcaaggtgttgggcgcctgtagtcccagctactcgggaggctgaggcaggagaatggtgtgaacctgggaggcagagcttgcagtgagctgagatcacgccactgcactccagcctgagcaacagagtgagactgtgtctcaaaaacaaaaaacaaaaaacaaaaccaaaaaaacaagattacagttatgacaggtattttgacccctaactatgtgtcagcactctgtatagcttatctcagtactaacactaacacccatatgatgataccagagcttttaaccccattttctgaaatacagaaactaaagaacagataagttgctgcgaaaagccatataaatattaagtggtagagtcaggattttaaacagggtacactggtttctttcttaatgtattttgatccacatctacaggtgaaattcaaatgcagcttattgaattttctctcaaatattatggtgaattattttattatcttagtgtttcagatacgccttttgccacatttcctcaagaagttgatatactattaagaactaggctatatttttaattttttgttaatttaaatccttcatagaggccgggcatagtggctcacatctgtaatcccagaacttggggaggccgaggtgggcggatcactggaggccaggagtgtgagaccagcctggccaacatggtcaaaccccatgtctgctaaaaatgcagaaattagccaggcatagagcaggcacctgtaatcccaggtacttgggaggctgaggcaggagaatagcgtgaacccgggaagcggagattgcagtgagctgtgatcatgccactgcactccagcctcagcgacagagtaagactccattgccaaataaataaataaataaataaataaatactactttatagagccagtgtgggaagtaggtacattggggtatatcacatataggaaacactgggcaaatacttgtgaccctctagaaaggaataaaaaaactccttctgaaggatacaagttccagttctggtttttccttcagttggccttgaaccagaatacgttctctgggcctctctgactagtccctgtcatgttctagccccatcttaggattaaggccaagacccaaaacaagcaacatgaacatcagaacagcaccagaaaccccaggtaggcttcgcagatgaaaataatgactgtggcagccatgctactcaaatggaaggcctgctttctttttagaaggaacctaattggcaagtaagttgctatctgacttgatgggcgtaaactcaccgttctgcatcccactttcccgatcttcacttcagttgcttaaatggagtgcactaaacctcaatttgataattgcatcctcaaaacctttaatgaaggtgcctatcaaagtgtaaataattaccccgtaatcttgtatttgcaaactgcatcttggctgtttacgcttcaccgaggttcaaatcagaggttcagggcttccccagccctcacattcctgttgacgtcagaggaatttcaaggacctagaggacagcattgtaacacggttcaaccaaggcgttcaccttcactccctcccaacgctgacatctgtcattttctggtgctatttataaatccaagggagcattgctgttttgttttggtgctggtgatgcagacactcatcctcattagaatttttgccctgacgccgggcacggtggcccacacctgtaatcccagcactttgggaggccgaggcgggcagatcgcttgagcccaggagtttaagacaagaccaggcaacaaagtgaaaccccgtctctactagaaatacaaaagttagctgggtgtgatggtgggtgcctgtaatcccagctactcaagaggctgagacgggagaatcacttgaacctgggaggcggaggttgcagtgagctgagatggcaccaccgcaattcagcctgggtgacagagcaggactccgtctcaaaaaaaaaaaaaaaaaaaaaaaaaaaaaaaaaaaaaaaaaaaataggttctgccctgagcctttcaggcctggccttgttgctctgggacttgctccctcctcgctaacgtgtttccttctttggagattacccactttagctcacctggggaacacacacaccactgacccagttagggcttcttccagcctcttctcttttttccattcttttgactgcgttaattattcacaggaacccgtcaatgaaagcaccagggattatccaggaggctgaccaccaaattagaacaagaaaatacttgaaacagtttgcatgctgtctgagggtgcagctacggagagggtatgttttaggtgctggggtctgagagaaatgaaaagagacgccaagccaggtgactgacagaaggcaggcgacaaacccaggcttcccaggctcgtactttctcttcggtgctgtatttttcagcacacaaacttgctgagagtttgcagctgacatctcgagaagtattcttcttaaaagctgagcgaaaattattcacctcatgtgaaaacaagtgcgatttacatctaatgtgggtaattacttttacagttaattaaaagcgctctcattaaactcccgctgtgatgccaatgcatagctcttatttgcaaacagacctttggtttgagctcacctggtgacaggagactcctacctgaaacagggatgccgttctcggtactatgtttaattgtgctgagccagcaaccctcgagttacccggccttttaccccacgccagctctgcttgtctgcatggctagattttgagatatggaagcctcttgtcct

SEQ ID NO: 1686 - DNA, 96443 bp, Homo sapiens
aattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggagaattgtttgaacccaggaggcagatgttgcagtgagctgagatcatgccattgcactccagcctgggtgacagagtgagactctctctaaaaaaaaaaaaaaaaaaaaaaaaaaaaagaagaagaagaaagaaaaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaacca

SEQ ID NO: 1687 - DNA, 15943 bp, Homo sapiens
ctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggta

SEQ ID NO: 1688 - DNA, 11498 bp, Homo sapiens
gcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggta

SEQ ID NO: 1689 - DNA, 2902 bp, Homo sapiens
atccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgttt

SEQ ID NO: 1690 - DNA, 1545 bp, Homo sapiens
ctctgtgtgaaattccaaggatacctttctccaaattaagcaaatgctggaagttagtaataggagtacaaacagaccaactaacccatttgggaagtatatataaggtcatctggaaagatttacagttgccatttgctcatttaaaatgtagtgaggtgttttaaagagggtttgttcaatttaccaaaaagggaaaaaaagggaaaagaagaaacttattgttgaacgaacacacacacacacacacacacacaaagagcctggcttaatttagggataaagcaaagaagtcaatacccccacatcaactattgaaacctaagctattgctggagttgacagcgatgattcaaagctaagtttaggaaccacagtgactctccctctgtgtgatttggggtaagatttagttcttctttctgggcctgagtgtcctcacctaaacaacaggtataataatacctgccatccaccattacacagaaacctaccataggacctggtacatacagagttgcttaatatataacatttctctttcttcttgatacagttatagcagtacatctgaaaatctgaaagacatacccatcataggccccactgacaatcctcttgttatcaaaccggatgcatcggaccaattcttcatgtccctctaggactcttaaacaggcaccacattcaatatcccagagccttgaatgaaaaacagacctctgtgaaacaaattcccacacacgattcacactatccgtaagttttttatatctgttccatacagatacaatttttcactatcttggagctctttatttctatctcacttccagtacacaccacacatataaagctgtatgtgtacatttataccatctgtgtgtttccaagcactaacctaggaagaagccttactttttattctatttccttttatatgatttgaaactgtttttaatcatgcgtctgtattactatttaaataaaatcaacaaacaagaaacttcaattctatttaatccttaggcattctcttgatgtctgagttgataaaaaccatgtagacaaatggtgtaggaaagactcttctggggagacagggattgtaggcagtaaaggagaaagagcacagatgagacaaggtgggaaaggagatatcacgtacagccagggggttaagcttccgccccaggcacttctagcacagtggagtccataaggaccactgaggttagaactggcggaccagcaggggaggtggctgtctcttgatgaggcttggggataccccttccttgatactatatgctgaatactgggattgacggtttacaaagtcagagtgggagacttactaggtacacgcagtgttctggtggaaatataaacccattgacaacaccaagtctttttctctgcatatgatttatgtaacaattctggagttagagatcttttttcctattatgactgattttctacagtatttgtagaaaaaaatcatagctagttagcatgtacaaaataaagtgagcaaattaa

SEQ ID NO: 1691 - DNA, 3210 bp, Homo sapiens
acagaaaacaccaagagtttaagtagcaaatatactcactttggaagtagaaatagccttttgatataagatagtaattctcatttgctcttccaaatttattccctcattcgactgggcaactgcttggcaagcactgtgatagatgctgttatggattgcatatgtcctccaaaaagcatgtgttggaaacttaatcccaaatctaacagtgctgggaggtggggcttaatggtaagtgtttaggtcatgagggctccactctcatgaatggattaatgccaattataaaagggtttcaggctgcaagttcaatctcttgctctatcaagcaaagctctctcacgcccttccatcttctgctgggataatgcagcaagaaggcccttttgagattcaggtcccttaaccttggacttcccagcctccaggtgagctctaagacataaatctctgggccgggtgtggtcgttcacgcctgtaaccccagcaatttgggagcccaaggcaggtggatcacctgaggtcaggaatttgagactagcctgaccaacacagtgaaatcccatctctactaaaaacacaaaattagccaggtgtggtggtgcatgtctgtaatcccagctacctgggaggctaaggcaggagagtcgcttgaacctaggaggcagaggttgaagagagccaaaatggtgcagcctgggcaacaagagtaaaactccaactcaaaaaaaaaaaaagaaatctctggccaggcagggtggctcacgcctgtaatcccagcaatttaggaggatgagacaggaagatcacttgagcccaggagtttaagaccagcctgggcaacatagggagaccccaccttcacagaaaatttaaaaattagtcgggtatggtggcacgtgtggatcgcttgaaccctgcctagaaaggtgaggctgtagtgagccatgactgcaccactgcactccagcctgggcaacagagcaagaccatgtctcaaaaaaaaaaaaaaaagaaagaaagaaaagaaaaaagaaagaggaagagaaagaaatctctgttctttataaattacccagtctcaggtattttgttatagcagcacaaaacaaactaagacagatgctgggaatgaatatgccatgaactgaagatgacaaaacagatatgatcctcgcccccatggagattactttctaataagagctgattgtctagcaggggattacgcaatacatttgtgtatcagtccgtttcatgctgccaataaagacatacctgagactgggcaagttacaaaagaaagaagtttaactggacttacagttccacatggatggggaggcctcataatcatggcagaaagcaaggaggagcaggtcacatcttaagtagaatggcagcaagcaaagagagagaagcttgtgcagggaaactcccctttttaagaaagatcagatctcgtgagacttattcactatcacgagaacagcatgggaaagacctgctcccatgattcaatcacctcccacggggtccctcccacaacacatgggaattcaagatgaaatatgggtagggatacagccaaaccatatcaatttgtaaactacagttacattaacagctgtaaaaataaaaaaagaactgactgctgctagagcatgacaagggaacttaatctataagggtacctaggggacccaggcatggctcctaaggagttgacacttcagctcaactctaaaggacaagcagaggttaactagacaaggaagaaagggtgacccctccctaataatgagaacaaattataatgcttgttgtaaccctcaagcaggttcagaggaacagagaaaaagaaaaaaaaatcactgtgactcaagtgcagaaagcgagggtgaaaaagagcaaaaatagacaagactcaggaggaaaacagaggtgtcaaagttggggttactgactgatgcaaccaaaatcatcaaaggaatatcaaagtaaaagacaaactacattggcacttgaaacctgtccagtggtgccctccacatatataagttttttcaaggtatttctataaacataatacaggaaaaaactggacgagaaatagggttcagtgcatattaagaaataaaagcccacctgagaaggggaaggaattcccaacagaaccccacctcaaagcagcaaaggctagtagtaggagtgagagtccttgaagctgtcagtgaagccaacagcaactgatcctaaagtgtctcacagagagcatccagagccagagtctacgcagagaagggacccaatttccatttgccatggacagtatgcagagtgaggcaaacacttccacagctggcttttaacaaaaatggccatttcaatcacaaaagggcagcagcagtgccccagtcacgacaaaatcagaagttcctcaccctagtgatttccttccgctacactcccccatgcacctagaagcagcagagcagaactacagctaattttaacacttctctttcttcacaaaagaaatacgaatagccacaaacattagaaaaatacatccaatgtcactagtaacttaaatctttaaatctttaattaaactgagattttttgatttattaaaaccctaaaatggcataaacatgaagaaagcatgtttcatgcagagaatatagtctgtcatgtcacatcatgttcataaaggttaagaacagtgggtaaaacctttggctatatgaaatactcatgctcttaaaaaaagttagagaccatcctgtgcaacatagggagaccccattttgtctctacaaaaaccctatattttgtctctacaaaacttcaaaaattagccagtcatggtgttgcatgcctgtagtcccagctactcagtcaactgaggtggatcacttgagcctgggaggtcaaggtatgagccacaatcatgctactgcattccagcctgggaaacaaagaccctctctcaaaaaataaatatatacatacataatacatacatacatacatacatatgtacatgtatatgtatagatgaaggaagggaagaatacataccatatattaatagtagttataatggaaactttgttctttttccatcttactttacgtttttcattacatttttccatcttattttacattatatttattttcattttttctataataaat

SEQ ID NO: 1692 - DNA, 3120 bp, Homo sapiens
gagttgtggaagagttttgctattaaaatgtgttttctcatgaattgccttgttctgtccactcacatcccatatcaggtagttgggagctatgttgttcccactgattatattcaaaaacagaggtcacatgcagttacgtgactgtatgcttttcccaagcacaggtgtcgcaaaatggttagacaactgagattttagttgaggtatattgattaccaatctgatgctattgtcacctgaacacacaccccttagcatggtacccaaggccctctcccacctcagggttgggggggatctgttcagtcctctgtcactcggtgctccatctgcaaccccaaggatgttcagggatgcctgtgaggtgagctgggctggtgcccagagactgagggcttggaagaaatccaagaggcccgagggtagcaaggttaaatacagtgcactgagctttatctaggctctccttttccttgtgtcttgatttcccgtgggagccacagcctttctgtgtggtagtccattctcttgtactattggttaactatggaagtcagtgatgaagccaccagcctcttcaggccctgtgtgccatgtggccacgttagagaccaaatgcatcccagaaacactaagtgggatctgaacctcagcccctaatgtctcactggtctgacctgtgagatacctcaatacctgccctaagcagaagagcctgctgggcactgggttcaaagcctggctccaccacttactatctgggggaccctggatgaggtacgtaaactctgtaggccttcttttccttgtctgtaaagtgaggtcaatgatagtgcctgcctcaagggattcctatgaggataagagttcatgtaagcaaagcctttagcacaacactggcatcaaatatacaatctggaattgcatgctgcttctggtcatctctgtggtgctccatttccttcactgtaaaatgtgggtcatgacagtatctacctcgtgggactgttgtcaggaataaacagagtctatccacctaagtccttagcattgtggccaggttcttagcgaatgctcaataatgttcagttatttattagtagtatgattattattacagatcagtaattctatgaattaggatgtctctccaatcttttgtaatggcagtccacagatatcagatgcagtcaaacctccagagtaccaaacttaagtctatgtgcttccatggagctaaaggtacagatgaacctgcagttggagtccagcagtgtgtcagcctggtacccttcttaccaaaaagaccaacttgtgggtaaagaagcaaaggttccatgtggccagatgggtttacgtagccaggcctgaatgccagctgctgcttcaggaaattctaggaggcaagaaattcttgtccagcaagaagttctctttctataaaaaggcaacagaatggaaagggccaacaactttgcacgtccccccaaaagtacccaactttgagggaaggtcacatgtggtggctttgagcccagaaatgtttctttgagtacagaaacaaaatgatatttcccccatgttgttaaggggcagctggagggaggttttgttccttcctctccttctcaaagagcttcagggacacatcttcctgtttcaagagctctgaggacagtcttggtttgccatgaacttaccatgtatgtgtggatcagtcacttctgacttggcctcagtttctccatctggtaaaatgaagatgttggattacatgacatctaacatactttctagctctgacaatcaattactcagtgatttcagccatggtaagaattggaaattcatcccctggcatataaatcaaaccattaaaggaaccaggggctggttctgcaggctaaaaaaggacagctagcaatgaggttcttcactgatccacagacacgctgtgaaggctggtgagcccttgcatggacgattgtgtgtgtatccaagtggtggcagggctagctagtatttttgcctgcctagctttcttgtccctctcttctagaatagaatccattttcccttgttggaaactgctccccccacccccaccagtgaggctgtcaaccacatggccttgaaaaaggtaattgtttgcatgatccaaaaaagaatcaccaagtgtccctttaggggacagatgtagatgtagctcagagagttagtctctcctctaaaaatcaaaagtactcaaagctgttggaagtcatctttacaaccaagtggagagagcttaccagagtccaaagccaacccaatagaaagtgcagagggaaacagggagagaagaaggaggggaaagggagaagaaggggagagggagggagagacaagaaaagggagaaagaaaaagggaagagacaaaagatgagaaggaggaagagagggagggatcaggagagacagaggaagagattgagagagtgagaaagagaaaggtaaaaagagaaaggaaagaagaaaggaagaagggagacaatgacagtaacttaaatttcctaatgtgaacttctgattttctaatttgaacctctagatccagttgtacataaaggaagacttacgtctttgcctttccagttaaatgagccaatgacttccctttttacttaagtccatagggttcttcaaatggggatccatgaccctcaaaatgttagaaactgcacaattggagcatttattagagatagaatgaactcacttcagaaagaaacaaggtttatttgatgaatataaataaggcgatcagcacaaagtacttctcatacacatgacaacaaatttatgaactgtacataccttgtacattgttctactagacacgaggttacaatgactggctaatacatgcccactggtagtttccagggttccttagttttatttatttatttttcatatcgatgtccataatcacatggtcaatatcacaacccacatgccactcacttgaagaaatattacaagaagcactatcaaacgagggtctcggggaattagatacactgaccctgggcagcattcaatcgccactctacacaaaaacattgcagatagagc

SEQ ID NO: 1693 - DNA, 621 bp, Homo sapiens
ggaggatcaataagatgcctaggaggactggaagaactttggacaacatttccgcggagaccggcgcgaccacctgcgcggaggtcgcggctcacgctctggccgcactgagcgcggggcggaggcttttgctgggctccaactttcactcctcccactcgccccgccccgtcccgcgctccccgccccaggcccgccccgatggaaatctccgacgacgtgacggctgctgcggtggggagccggggaggctcgcgcgggcgcgggaaggaggcgggagcccggttgctgaggccccccgtccccacgccgccactgcggcgctgccagacagccaggggcgggggaggcggagggaggaggcggcgagcccgcggcgcggggcctgggcgggggaaactcgcgccccaggctgtggccggcagggagctgcttcagggacaagatgtggggctggatgtgctcacgccccagaggcgaccccctcctgcccgctggcacgccgcggggtcaaactgtgctctccagccgtggcttcctccccgccacctgttgcaccccattgcttccccaagtgtcctggcttcaacctccctctctggttttcccagctctcagccc

SEQ ID NO: 1694 - DNA, 2585 bp, Homo sapiens
cttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccgtgctcaagggctgggcctggagagtgtgcagcatcctcatgatggcatcgccttattttctagaatttgtctccaaactggactccagaccatcctgtcctcagccccgagtcaccttcatccccggtctctgttttccactcccagtcccaaaccacgcctcctgcacgccactcacacagccggcagaaactttaatctccccacgtttaaaaaagttttctcagttataagactctctttttctcacattttagcattcctaaaattgagttccatcttacactcattgtcaagggaaacttggcaccaggaggggcaggagaggtgatctgggggtgtccacggcagcctcaaagagatggttggtgtcttcacctctgagacctctgatccattgtttgcactggaagcaccatgaatgggtgaattttaaaatctgaaaacatatttgtcacttaaaacgccattagaaaaagtaaactccagtgtagtttctagtgaaattttattatgtatatagaagattacctgtcatagacaggcaacataattaaaggccatagaaattgccaggctcgtcagatagatctatattaggaaaccctcagcctccagtaacagaaaccacaatttgaagtggcttgaaccataaggtcatgtgttatctcggggaacagtgaaacccagagggatgagggctcctgggcaggttgagtcagtggcaacattaccaaggaggtggcctttttaactctttttttttttttgccatcaacttcagacacaaaacgtccagaggaagaagacagcagtgtgtggtgaagcatgccctttggatcaagagcactccaagctgatttccttcccattccatgtaccacacagcttaggcctgtccacccccaaactaatcactgtcaaggggatggaactaccatgattggcttgcaataccagtgtgagacagcgtggatataggaaagtcatccacaatctccacaaccacatcctcgaagcttcatagaggagaggctggccaactgattcgtgtatcacaaaggaccatgattcaggtaccaagcatctatctgtcagatgccaggagctgtgccatttcctccaatagacaattcaattaaggagaaactaaaacctcgagcaattggaaagagcacatgaaaccccagtgttctttgacatgctgtagaatgacactgttgttcccaaatattctaaatcaattggggtcctgaacaagaacaacacagagcagcctgccgccgtgatgcccaaagagaatcattttagaccctgaaaatgtgaagaagctgaaaactgaacttggattttcatatgtgtaaaatgtaataaaaggtgatgatgattaatgaaacatcatgctttaagaggtacaattctgggccagccaaggtggctcatgcctgtaaacccatcactctaggaggctgaggcaggcagatcccttcagcccaggagtttgagaccaacctgggcaatagggcaaagctgtttccacaaaaaatgcaaaacataggcaggcgtagtggcatgggcctatagtcccagctacttgggaggttgaagtaggaagatacactggcttgagcctgggaggtggaggttgcagtgagccgagatggtgccactgcactccaacctgtgtgagagagtgagaccctgtctcaaaaaaaaaaaaaaaaaaagagagagagacagaggtacaattctaattacaattatagtaattaa

SEQ ID NO: 1695 - DNA, 995 bp, Homo sapiens
cttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccgtgctcaagggctgggcctggagagtgtgcagcatcctcatgatggcatcgccttattttctagaatttgtctccaaactggactccagaccatcctgtcctcagccccgagtcaccttcatccccggtctctgttttccactcccagtcccaaaccacgcctcctgcacgccactcacacagc

SEQ ID NO: 1696 - DNA, 32 bp, Homo sapiens
gatgcaatcacagtaatagccgccaatcaggt

SEQ ID NO: 1697 - DNA, 154167 bp, Homo sapiens
  misc_feature (15129)..(65128): n is a, c, g, or t
attgaggagagaacaggaatcacccagaaaacagactgacgaatattttgagttagaatcctgccacccatgacaagtcagctcccacccctccagagtctccagctagagcacttgcagtaagagttcagtgggcctttccaggcagccaggcatgtgctgccctccggattcattaacagggtttcttggggtcagaggaggtgccaaagccctgagagaagccaagccccagaggactcccaagttctccccgcagactcatattcctcttgtaggtgggaaagggacggagaggtgcagggggaacgccctgttccacatgccgtatttactctgggcatggctaatgactccagggccttatcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacaggtgagaagacgtccccgcactgtgttcagctgggtagtcccatgccctgcaactcagggctgctctggggtaggaaagctgatggggaggtgaagaggaggagaagctgagggcttgcgtcaatgcatggaagagactcatccagtgaccgcctgtgtatggccttaatctccagtcctcaacaagtcatcctcctgcctccacctccacggaggtgccttcccaagtcccaggggtcttcttgtgttgcaaaagagcaggaacctgcagttgtggtttgtagctcaaagcgccccaggacttccccaggggactgaccatcactgtccccaagagtttttctgtccctttaaatcagcccttcgtgatgttcatgtaaaactgtagaccgccccacatctcccattttcctagatctcaaagacctcagctccaggaggggagccatttccactctaagattctaagactctatagggcagagatgaggccgggcaggctgagtggcagagaggacgctgatcccacctgtatcctgcgtgctgtcttgcagatccccccctcccaccccatcttctctagttggcccctgagaaaatgggacgagaatggggggaagagggaggcagaagtacatctcctgcttacatgggggtttgtctccagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatgtgaggcctcctggggtcagggctggggagaggtgggagcgggaggaaggcccagcattagggcatggccagtgccacatcagtagcaccgaaggccattgtggatttcttcacttggatgatgatccatggggactgattccctgggtccccatggagttggctaagcaggcccccatgtacccaaatgtcagagttctctgcagaaggaaagggctgggagtgaaagcatcatcccacactgaaggcccctgcttctgctctcagctgggcagcttactggctgtgtacccttaggcaagttacttaacctctcccagccccagttccctggtctgtaaaacagatggttcttcctccactgcctctcctacaatgtatttataagaatcaggttagtgcaagtaaaatcaaatgaagtagccagaggcttggtttgatttcctccttcatggccatttctctgctccttttaccttttattttccagcgttgccacttcctaggctctgtaaactccagtctgtattaccccaggctctggcccctgggagctttcccctggcttcctggtgagcacccttgtccctccccaccacccacaccctctttccttctcactcttccttgcagatggaatacttcggcactatctccattggctccccaccacagaacttcactgtcatcttcgacactggctcctccaacctctgggtcccctctgtgtactgcactagcccagcctgcagtaagtggggccaggagcaccagcagagaatgtctgggggctagtcctgggaggccaagcctggtactctggggaaggggggcttaggttccagaaactggccatccctgccacaccagcttccactctccatctttgagtcagccgtggaactgcttatagcagagatagagcaaagccaaggaagaactaaaatgtggctgctgtccaagagagtaactttcatactgatcagaattaatagaaagaaagccattgaaaagagaaatctttgacataatgactcacttcctttggaacacccaaaggaatgtaggggaagtttaatttaattggttatttctgagcagggaggtgagtcgggttctagtgtagatagtctgcttgtttcaaggaggcttggtagccttatctcctggtgcacacaggtggggctggtggggcacaatggcatgggtgggtccatttgtccagaggtaactcagaagtttcagtgaggattggaaaagaagagctacagaaagatgtcttgttcgatacaggacaagtcccagagacagaatgtctctggaaaccccaaggctagagatgtccatcggttgggagaaaagttgggagtaatttcctggggcaattgtttatccctgagtttcttttgaagccaacctctgacccacaatgggtggcagggactgtggctggcgcctgataaatgacacttatcttggtgtgcctcatgaggtcattgtggacaatcaggtttgctcagggatagctatttggtccccagttaggccacatctgtagctagagggaaatgtagttgttcattagggaggggcatcaccaggcttctaggggcccccactcagtgttgagagctgagggaagagaccctgccgctgtggggctgggtggcattagggcagggatgcagccagtgagccgatggcataagcaagagcagtgcacttctttccagagacgcacagcaggttccagccttcccagtccagcacatacagccagccaggtcaatctttctccattcagtatggaaccgggagcttgtccgggatcattggagccgaccaagtctctgtgagtgcaagtccttcattttttctctcttggacagaaacttgggagacttattcagaggtcttacatttcaaatctgcctcaggaatgggtggaaacaggggttagcactaacttctaggagaaagggcaagcaacactccccacctgagatggtggcagtgggtcagtctccacagcacgctgggccctgggggagagcagcacagggggactctggcaggaagcagtgcccagtgcacaaagcctggtggcagggtgcacagctggatctccagtctctagggcattgaggagataaaaccacgtctccgtcttgaaggataaagaagtccacaccagggggagagatttggactcagtaacataagggggcaaggtctgaaatgggagtccaatcacagaggcaaggcagaagcccagttgtccaaaggccaaggtccaaactgaactcagtgctgagctcatgagctgttcctcaaactccctctgacctctgaccctctgactccctctgaagtcctatgggtcctagaactatgggaatcagacaaatgtggggacagagagccaggtactttttcaggcttatagacagcaatatatgcctgggccttgggagaaagagaggttgacctactcctggtgaacgttggtccctggggtattcccgaggccagcagggcacagccttcatcaacatcccttagagtgggtggagtaggacatattatcaactgaaagaatgccagaagcagaaaaacaccatctatgtaaaaatatcatacagataaaacaatgtactgtattttctattggaactatgtatgcgtgtgtatacacacattacatatataatatataatatataatatccatatatgaatatatgtaatatacagtatatttgtatatataatatatatccatctgtatatattatatagatacaatatgtaacatattaaagtatataataattgcataattatatcatataatacatgttatatattatataattaatataatatgtaatacattacattaatatatgttatataatatataatatattatagaatataattgatataatgtattatattaataatatagtatgtgttatataatatattaatatgttgtatgtaataatatattacataatatattatgttaatctattatataatagattaacctattatataatagattaacataatatattacataatatgttaatctattatataatagattaacacaatatatatgtaatgtgtatatattatgttatatataagattctatatatattatgacatatacatatatattatatatctaattacatataatatatatataaaagttaaaatgactattttgaaggctacatccctaactgatcatcacagtaacctctgagatgcagggaagggactgaaattagcatagaaaggggaattcaagcctatagcttgtcacgtatctgttggctcacctggctggtgtagggcagcagccaagcccacagcaatgtcagctgcattgctccttccctcagtttttctggctccaggaccaggtgtgcacttacctctaacaaatcatcagcttttgctgcataacatccccatcattgaggctggagacttggggacagtgagagaacaatgtgggttccagtccaccctcaccctcatgggttccaactggccctttttctcccacttgacatctatcttccctttctgctgtgcaaactgtagactgctgctgcagcatcaggacagaaacagtatcctaaagtacactgtttaactagcacccacagttgcatataatcaatatctatatccacatcattatagctatatctataatctatagtacctcctaatggttctgcttctcttatcaaaccctgactgacataataaagatatgacatgtgaaaatttgtagatgaagctgatgcagcccttaaagggaccatttagcctaaaatgcatgcgttgttaatagaaatgctaatgatcaattatctaagctcctatttcaagaaatgaataacaagaaaatgagcaaaccgtaaacaaacaatagcaaatcaaacccaaagaaatcaaaaggaaggaaataataaagagtagaatgggacacaaatgaaatagagaaatcacacagtacagaaaattaacaaagccaagaatgaactctttgcaaagagtaataaaattggttagcctctcacatgactaaataagaaaaaagaaagaaaatacaacttaacaatgttagaaatgagaaagagaacattagtaaagttatcaagaataattttatattgataaattttacaattttcagaaaatcaacaaatgccttgagaaatacagcataccaaaactgatgcaaaaacaaaaaatagaaaatgtgaatcttttaaagatatactctgttattaaaaaatctttccacaaagaaaactccacgaagaaaagcctcactgataaattctctcaacactaaaaaaaatcagtctttcacaaactcttccagatatttgacaaagtaaaaacactttataactcattttatgaaaccagcataactttaataatgaaacttgaaaaggacattataacaaaagaaaatataaaattacagaccaatctcttctctcatgaatatagatgcaaaagttctaaatgaaatactagcaaataaaatcttttggtatataaaaagatcataccaagggtcatctttccaggaatttatcatttaacagaataaaaggagaaaaatcatatgaccaatatgattatattagtaggttaataacattcaatatctattcatgacttcaagaaaaactcttagcaaactaggagtagaaagtaactcccttaatctgataaaaatgaaggacttcatctaaaagaagcccacagcaaactttatacttaatggtgaattgtcgagagacttctccataagatcaagaatgagacaaggacactcaatctcaccacttctattcaacattgtactgaaaatcctagccagtgcaacaaggcaagaaaaaagaaataaagaacattaagatggaaaaggaagaaataactctgtcaatattaatgtatgacaagattccataagtagaaaatccaaaaatatctacagaaaggatattgggattaatatgtgaacttagcgaagttgctggatatgaggtcaacataaaaaaaatcatctggggccaggcacagtggctcacgcctgtaatcccagcactttgggaggccgaggcaggtggatcatgaggtcaggagtttgagaccagcctgaccaacatttctctactaaaaatacaaaaattagccaggcgtggtggcacacgcctgtagtcccagctactcaggaggctgaggcagaagaactgcttgaacccaggaggtggaggttgcagtgagccaagatcatgccatggcactccagcctgagtgacagagtgagactctgtctcaaaaaaaatcatttggatttatatatacaggttatggatccttatcccaaatgcttgggaccggaagccttttagatttcaaattttttcagattttgaaatatttgcattatacttaccagtttagtatcccaaatctgaaaatccataatctgtaatgctccaatgagcattttctttgagcctcatgttggcactcaaaaagttttggattttgaagcacttcagtttcagattttcagatttgtgatgctcaacctgtagcaagtaaaacaaatggcaaatagatttttaatgacactatttataatactatcaaaaccatcagctactttgatgtaaatttaacaaaaaatgtgcgagaactctactctgataatagcaaacattactaaataaaagtaaaagacttgcataaaaatcacaaacattaatgaataaaattaaaagaagacctgtattgaaaactaaaccatgctcatagattgaatgactctgtttcattaaaaagtcaaattttttcaaattggtctatacaaccaattttattccaatcaaaacaacagcattttttcttagacattagcaaactgattctaacatttatatggatatgtaatacaccaatacaatcttgctgaagaaaaacactggtaaatattaagatttattataaagttacagtaatgtagacgtgtggtgttggcacagaatttaaaaaataaacaaatgtaacagaacagaaaatacaaaactatcaacacagtcatctgacttgcgttgaacaagatactgcagtatgtggaggaaatgatggtatatttattaaatagtgccaggtcatatgaatatccagatagaaaaaaataaatcttaattcctaccttacacattatcacatttcatataggttccagatcgcaatgtgaaaagtaaacaataaagcttttagaagaaaacatgagaaaatgttttcatgaccttaaggtaggcaaaattttctgaaacaagttacaaaaaaacagtgtacaataagcacatgatgagtgacagaagccagataccaaagagttcatatgggatgattccatttatataaaatccaaaaaataggcaaaaccaatatatgttattagaagtcaggagactggctcttcttgaggaggggcgcaatgattggcaggtgcatgagggcttctgaggtttggaatgtcctgttttttgggaatatagcaagcatctttgtgctcatttagtcaaggaaagttgggaaggagaggcattagcttcaagacagaggaaaatccaggagtcaaaccctttgccagcaatcccctgtgccattctcctgttctcctgtgggctttctcctaccaggtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcaggtaaggcccatcaagtctgtgaggttaaagtcagttataactacagggagacaacacatacacttgacttagcagtcaaaagacctggtttaggtagcttggtccattaccagctgtgtgatcttagtcaaaacatttaacctctctgaatattgaggaaatgggatttgcttcatcaagtagctgtaaaaacactttgtaaactctaccacactggcttaaatttaaggaatctctgggattggttcttcattgatgctgtcactaaatatcaagctcctattatatgctgattatgatgctcacactggggacccagtgaaacaagaaagacagtacctgcaggaggaggaggcagaaaaaaatgaaaagctgacaataaaataattgcatgctgatggatgaataaacaaaatgtggcatatccaaataatcaaatattattcagccttaaaaaggaagaaaattctgagacatgctacaacatagaagaaacttgaggacataatgctaagtgaaataagctagtcacaaaaagacaaatactgtatgattccacttaggtgaggtacctagactagtcaaattcataggcagaaagtagactgccagttgccagagcctggggaggggaagtgaggaattcttaaaccgttgttgatggcctaatgggtataaagttccagttctgtaaaatgaaaggtctggattttacaacagtgtgaacatacttaacactactgaattgtagactcaaaaatgggtaagatagtacattttatgtgacatatttttacaacaatttttaaaattgcacattgtttttggaaaaggtcatgaggctcacctgtttctaggcactcttgcccggcatccttggagggtcatctcctcttcctccttacacaggaaggtgatttctgaccttgctgactttttccagctcagacctggcctgcgttcacactgtttcagcataagcccattcctctcattcccctctcccacatggagggtcctggattttccctatcaagctatgtttcctctccagcatgacagcactcaggaccaggcctaggaagagctgtgagtaagagaggcaagttgtctagacacctctgcttccccttgcagaacttccttctcccgtcgcctgggaaaagtgggctgtaatggagaatatcaaggcttggcagtcagactggcctggatttgaatcctgccacttacattgcttcatctcactgaggctcagtttcttccacggaccactaggttgatgtgagttaaataagtttagacagataaaatccccactacacggccttgcaccaaggtaatcaacaaatgtgagttcctttccccactccctctgtaaaaccactgtcctaaaattcctacaggtattcactcctctccctctttaccaccctgatttcagttttgtatctttctgatccttttcctcctcaaaatgaatctgtcttaggtcctatttctccagagtcctgctaggttccagaacataatctgagaaatcaataccaatgaaaataagttttcaggctctagtaagtcatgatacattcatattagcctctttgccttaacataaggagtgaataacacaaaaacgccaggcactgtcacaaccatagtggggaagatactttgggaaaaggtgtctttgggggttgcttcaagccacacagtgtatacccacccaggatggtcctggccttggttctgaatgacagacctgctggccccatttcccacctccttaacctttttatccaagaagcagaaacacattcacaaatggtcaaggggagttgtttctaaccttgtgtcaaaaaggcccagaccaattcacttgcagtagtcagagtcccggtctcaaagcccagactgatgtttctgcctacctgtgtgcttggcatgagaccaagaagcaaagggtcctagctgaggctcacccctagagttttgcagtggcccttcctggacagtttgtctttctctccatgtagtaacccagaaggtggtgcggggagcgagctgatttttggaggctacgaccactcccatttctctgggagcctgaattgggtcccagtcaccaagcaagcttactggcagattgcactggataagtgagtattccccatgaagtagtgacagtactaggggtaaactgaaaagaggcacaactcaaaccgatttaactgaaaaaccactggtcactagcagaggatgccagaagcttactgtggttggaggtatggaggtgctgagcaagtgtgcaggaagggacctctgtaaccagggcagcagacacagcttccttccttgtacacatggcgtgcttttaactcaacatacagtcaataccagtgcacagcctgctcccctttgttcttttaacattaacacacaaggcaagggatgagtaacatggggggttgcacaggtgaattgggctcagatcttgtcctcaaaaaacttgtacagaagatgagatgcacccaaaccactatcctgtaaaatggaaggtggtcagtgctccaagagaggtgccaccaatgtggtccagcagacaggcatgaccgcttctatctgaatgctccagtgcatcatggagggggttacattgaaactgagccaggaaatatatacaatatctgggcacgaagcaattggggaagtgggactacatgcctgcctcatacctagcgccgtgctagacaatgcaggaattggaaaagtgtagttcaagtttcaattcagctaggattgagttcctgcaaggtaccaggcattaggaatgcaaaaaataaaaggcctcaatgctcactgtctattcagagtttttcaaactgtaggaattcacctatttatgggtcatgacatcattttagaagatcctgacctgaccaggtgtggtggctcacacctgtaatcccaggactttgggaggccgaggcaggtggatcacaaggtcaagagattgagacacctacattttttagacgaattggaatacagtagaaaataccagagtgcacttcaattgcatgaatgtgtgtgtgtgtgcactgggtcaagaagtaaacagatttcttcctatggatctcagtagaaaacaattgaggaacactcatatggtgggtggaaatcattgatgtgctccaggcatttgagaggccaaaaaagagtgggagtttcctaggagccgggggagggaaggtgggccgaccacaaccctgtcccctcagcatccaggtgggaggcactgttatgttctgctccgagggctgccaggccattgtggacacagggacttccctcatcactggcccttccgacaagattaagcagctgcaaaacgccattggggcagcccccgtggatggagaagtgagtgcctgcctgcgcaagggagtggtggggacaggagagccaggccttctcttgggaggtggcaaggctctaaacggatcctccgtattgggttttagtatgctgtggagtgtgccaaccttaacgtcatgccggatgtcaccttcaccattaacggagtcccctataccctcagcccaactgcctacaccctactggtaagaactgtttccttattctgcaggccacagggccctccccacatgcctgccacttccccttttcaatcgcctgcactttgcccgcctttaccctaagccccgccccacgttgttctgctctcatgtggcattccctctgggagggacacagctgcctgtggtggaaagaccacggggcttgctctaatttccagttctgccatgaagcagtagtgaacttcaggcaagccatttaaggaagtcttctgatattgccatgtagggcttttccactgacaaagtttaatctcctcaaccaccaggtcagactggagctattactatctcattttataggtgagaatatcaagactcagagagtcaaataaatggttcaagatatgagctgtttgcagggaggagtggagaataagattatatttgttctaacttcaaattaacattcctcctctagcaagaaaatgtcttttgttgcagtaaattctcaagtttgtagggtgaagtagaaagggaactcccagaccttttggacacctatgagcacctcacaccacagttggtctgaattttcagcattctaggtattcggcaccacacttcaacacactaatttttccaagagtcactcacagcatcagggtgactgcatcagaagaggggtgctaaggtatagactgagggcttcagccctacccctaagcctctattaactccttcccaaagccaccaacagacaatccaaataaaaacaaatgtttgctttaaaacacagcttcatggtaagtcccctaagctcctgccacatagggattatggagctgccactctgaacaccacactgaggaccagtgagacatttagactgagccctgttcatcagtccacatgcccatcaacaccccagcacacccacactctcaccttcccccacgtgagttgagtccctgcccaggtggaaatcactgatgtgctccaggcgctggagagcccaaaaaagagtgggagtttcctagaagccaggggaggggaggtgcgtggttctttcccggtatggtgagtggttcttttagaagatcattttagaagatcatgacctgaccgggcatggtgactcacacctgtaatcccaggactttgggaggccgaggcgggtggatcacaaggtcttgtgctggttctttcgcagtacagtgagtggttctttcccaccagcagatttcaatcagagccaccttgatccatcaaaactgctgtaaaaattttgacttttcacgtccttcctctcaagaagtctccctgagccctctgcaaattttcccacaccctcatcagcaacttcacatttcaaatcattgttggaaagaccacacttgcctggtagagcacgtctttgccaaactaaaaattagattggagaaggtgacactcttctcttgaacaaggaatgcctacttgcctcatctaaagggggtcactcaaatgtttgtttccagaacatcaacaagaaaatagcagtggatagccactaacacagttctttctctcccttaacaaaaactaagctgagcttcactagaaactaaagaaaccagaatttaaaccaaggtcttccggtgccaacccttttgctcttctagccatgcagcaagggtttcccagttgtaaaatgatggtgacaggggtaggtgggagtatataacagatgaacagttctcaaaattgtagaacatagaccccaggcccataagaatggacttgtgcagacaaacactttattaagcaacctagggtagggacatatgaagcaggaggaagaacccaccgaccaaaatggtggaacccaccagctgtccaaggccacccagtgccagccaccaccaccacacaggcagcctccaggcagtactactaccttcttcccccgtttgtcatttgcatccttctttccaacccacaggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcattttacctgatcgtttcagtggtcattgatgatcattgctgagatccacactataattaggggcggcagaacaggtgtttttctaattctgctatccctttggcatttgttagttggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcctgtttaagcggagcatggtgacttatgcctgtaaccccagcactttgagagggtaagataggaggatctcctgaggccaggagtttgagaccagcctaggcaacatagcaagaacccatctctacaaaaaataaaaaattagctcagcatggtgatgcacgcctgtagtcctaacttctcaggaggtgggaagatcgcttcactccaggagttggagcctacagtgagctatgactgcaccgctgcacaccagcctgggtgacagagtgagaccctgtgtctaaaaaaaaaaaaaaaaaaatccctggttaacagggaaaagagctatgtaaatagtataatgtgaaaagagctttagtagagatatgagaacacagctattttcaagagcagtggaaaataaggttaaataagtagagtagaccccaaatgatagctctttgatagcaagcagagaagttcagattggatgtggcagcattttagtgggtcctctgggttcttaggtggggagagagacacgaggaaaacagaaggccaggatgaaggttttggggtaatctacacacaaagtaagagcaaaaaaaaaaaaaaaaagtggggggagtggaaaggaagtaggaatatattcagaaggtattcaagaaactaaataggactggataactgactggataaagcatagaaccataatggtcagaggtgacccagtgtctctaccctggtgacctagaagaattgtggcattcacgatagaagtgggggtgttgagggaagatctgttttgaatggtgatcctactttgaacgttttgggtgtagagcagtacgaggccatcaggtatccaggtggagacggcatactgctgaggtaagaggttatgactggggatagctagcagaatcttcggagtaaaagtgattgtgggagagatgaaagtatatgaattcagggaagagaaagaggagaacaaagaactaaatccaggaccccaggcttagacaataaaagttttgcattggtagtaaaagttactatgaggagaagcaaaagctacctgaagagagagagaatagttttgttttttaaggcaaagggtagaaggtaaggtgggaaagtggcgtctgatggaactagaagtgttttaagtagaagatctgtaagagcaatttcttattgatactctctcatgtataaggtattgtgagagatgcaaagatgactaaaacaagccccaaacccagatgttttcaatctcttagggtgaaacatatgaaattgctgggtttttttgtaaggcaaaatggcaatttcatatggtacagcctggtagaagaggagatagaacatatgtacaaatgcatttaatacaggcaaggtggtgagaaactcaataagagaggctcaggcaacatcctactttcatgcataatttattcctaaaagtgtatacagaagtcaaatggttgaatgtctaactacagttttatgtggggtaggtaggttctattattataaataagtgtatatgtgaaattcgaaattatccctcacctgatatatttttagcattgtataccttgtctttagttctgtttgtttttccacaattaaactcgtggcctgcctgctcaagttcagtgaatacctaaagagtccacgtagctgatgagttctgcccttatcttagtagtacagtgatgagacctctacttctcaatgcaacattagtaacagcacttttgtttttccatttccactcatttttgtgttgcaaaagataaccaagtgttaaaatgtgtgcacagcacaagcattgctgtgcagagacaaccatcctgctgaaacagaattggtacctggcagtcagcatcactaagacaagcttgaaacatttgctggcaactgaaaatttgacattggcataggaaaggcatcttaggcatgtctgatttggtaaagatataagtttggctgatgtaatagaccccaagtaataatggcatacacaagatagaggttgatttctctctgatgtcatagtctaggtgttagccatccagggctgtcaggcttcttattccatcccgagagtgttatccttttctgtatgacccaagatggctcactgccaccatgttctcattccagccagcaggaaaaggcaacaggacgaggggcaggtatggccttattttttaaaggtgcactctggaagtggcacacacagctcttcaactcatatctgactggccagaacttagtcacatggttatgctgaactgcaagggaggctgggaagtgtagttattgttctgggtgactataaagtagaatttctctaaatatagaagaaggggaaatattgggggacaatcagcagcatctgccatggtgtatgaaaggacaagtgtaggaaagaccatggccacccatccatacagagtgccacaggtgcacaaagaagagagatttcttctgattggaggactggatagggctttagggaggtcaagttcaatggatgggagataaaaaaattaaaatgccagtgctaggcattgatcctttaagcttaatacagttgagacaatggagaagttgtagaaagaaggtgaaaagatgggaaaggaagcattttagatagagcagtattagaaaaggctaacagaagtgagaacaaaggctgatggataacttatctgttttgctgaagaacaggaattataaatgtgatagtgaaataaacctggaaaagataggggccagaagattaaagaggtctatgaatgccaggcgacagggttcgggctttattctgtaagcatgggggaccattgatagtttttgagcaaggaacataattatggctgtgctttcgaagggtaactatggcaacgatgcatatgatcaattggagcagagagactggaaggaggaggacctgttaagaaaggagtccagtggtgaggttaatgtgggctgaaactgaggtcatacccttggaaatagacaagatggggccaagtgtgaggacaagaatcaatggaattcaaagaagctgggacagagaaagtgctcttggtttcctgggtctctggagtgacaatagtactgtattttcattcagttggtgaactgtagccttgattttgctgactctaggactggtcccagaatagttcattctctgcccagaacatctcagcgggcactcatcacctcccccggagctgtagcagctgttgggctagcaatgccatgaatttgtcttcctgtactgccaggagagcagctgccagcagcaactctgaacagacccatctcagggacgtggaaactattcaacttgggatgcagcaggttggccagggctgaattcagtccacatggattcatctcacccttttccaggccactttcttaccctggctgggtttcagccactcatactgcgttaggttgggtattttcttacagttctaagtgattgcatttagggatggacgctgctgaactgcgttcttcatcttttggacacctcctcccctggaagccattacgctgtcagcctttggctttgcttcctactctgctctgctcctgctcaccttttgtcctctcccacattgcgctcagtgcagacatcctcattaaagcctgtacagttctgactccatggcagcctgaccctctggttccatccctctccttctttctccttcccccagagaatgagagatgctgcagatagaactgtagcgattatttgaccctatgttattctgctttgtttaagacaggtaacatggcttcccccatccctgtgaattgtgggaagaccctgctaatgtctgaaattctgtcagcctggattgatcaagagcagtggtaaagtattatgcgagggtaggaagcctttctagggaagatgttcttgcattttctttggctccttgaagagcataaatgtattcctatttgttgctgagcctttgattgtctcttttaagtggaatctgtgttaatatggcccagcaggactctaattgataatgcattggctgtttgtttgtttttttttttaaatagacttgctgtaaattacctttcggtcatagctcacttggttttgatctcctgcttttaatagctcatttttttaggtagcttttttttttctgttgagtttttagagcaatacttctacatttctgtcctgctgtgttccttgcagagaccttctgctattttataacccactgtcagtatcttttcagcgtttctcccagcttctttctctcctcaacacatatttgttgactattttagaggttttgttctaaactcttagaggacagagatccaaagaaataaaaggagtagttctttcccatatgaaattataatctagtcagggagaaattaaattcaaatacaagaatacaaatcttcaacataaagctatatgtagtaagtactaagtatatgctgcagaagagatgaggctcagttgatgtagacaggaaacttcagtaaggaaatgagatttgaacaaagctttaaagaaaatggctcttgagagggaggggaagatactctaggaaaaaggggcacagctagaagaaagaacaaagcacttttgaggtacagtgagtagactggtttagctgggagaataagtggatgtggaagaagtggacaaaggtagatgggtttgtattgtggagggccttgactcttgattagggatttggctctatgcaatagacactggaaaccactgatggtttaaataggtatgaactctgattaaggaagattaacctagtggtagtttgctaaatgacaagaaacatgagaccaaggaaaccagttgctgcagtagatcataaggatctaaattaggttgggatggtaggaatgaaaagaaggggaatttatccttctgtccatttagcaaatatatatcttcttaccatgtgccagacacatgccagatacccacccctgtactcctagagcttacagtctagagacagatggaaagcacctggtacaggaagaatctacaggaattgctgactgatgggattcaggtttcaagtgagcttggaagccataaaagaaagaggtctgtaaagtgtctttttgacttgggtgattgataaattaatggcatctttaaaagaaatagagaggggcttttttgtttttttttttgttttttttttttttgttgttgttgttgttgtttgggtttttttttagatggagtttcgctcttgttgcccaggctggagtgcaatggcacaatctcagctcactgcatcctctgcctcccaggttcaagctattctcctgcctcagcctcccgagtagctgggattataggcatgcgccacgacgccaggctaattttgtatttttagtagagacagggcttctccatgttggtcaggttggtcttgaactcctgacctcaggtgatccgcacaccttggcctcccaaagtgctgggattacaggcataagcctctgtgcccagctgaaatctagtgttttttaacagaagttaggagaaagaattgtttttgaaggagtaaaatatgagaaatttggttttggattttaagtttaaggtgttggaagagtattgaagctgaaatttctagtagttgacaaaatgaatggctgtatgcagggctaaagagattttttggctgttggtagagatttgcacacgtgcacagaggggatggttgaaactgtggaaatatttgtgatttccaatagtaagggtttagaagaacaaaggggaaacttcctttgtatcatctgtgatactcagattacagagtgtataaaggaatttaaatgatatatttatttgtgtatcattgagtatacattttgggaacctaattatgtatcaggaattgggtttagtactggagatagagaagaataagacaatctcctattttcactaatattaaattagcagaatatcaaggaggtagacatagaaagtaaactttcttgtttggctggttatcagttgtgtcactattggaagtgatgtgagggagcagggcctaggtatcttaagaatttggtagacattcaacctgcaatactcctttcagtgggaggttagttacacaattaattaaagaaaaattattgtagagtctgtgttctcggcttcaggcccagtatttgaatgtgcgccatctctgtagttacatcactactgcggatgggttcctcccctggagttgagttcaaagtcattcaccagtctcacaggatagcattgggttgaaaagcatagagtcagctggccatggaaaatgttatagttgtggttgcaaatcggaaaagggtggaagaccagaaggttcctcattgacttatggagtgaccttgagaaggaaagtaccaggaaacatgaagctcccgggagggagaacccctgacttcctgggaccagtgcgtcactcactcattttggacatatttgggagctgtttgttccctcaggaaagattttgcccagatgtagcatctggtgttgcaagggttggcttcccttctccatggctcaagatgcctttgttcagaaattaacagaaggttctttggtgtgttttgcatgggcccagttcatgtagaaccttaggtcattgttgagtcctttttggaggaagagttgggaggacttctcacacatgggtaaagcagaatggaagagacgcaagaaggccatttgggaatcagcaagacagggtgatccagtctttggaagagagaaagaattcagttaaaagttctttgggaagctttgtgactttgtgtgggaaaaaccagagctttgagccagaaaaacttgggtctgaatcttgtctcttctactcctagcttgtgaccttaagcaagtcacttaacccctgttagcctcaatttcttacctgtgaaatgttgacagtaatacttaccttgaaggattcttctaaggatatatataatgtatatacagcactagctaatgtttgtgacttaatggatgctcaataaatggtagctgatataattatcaggaaaagtcaatcctgatagttaagatcagccacagaagagtcagccctgatagttaagatcacaagttctgggaaccagatttcctgggttcacaatcctggatttctcccacttacttgctgtgtgattttagatgaaaggttttaatcacctcagtatcctcgtttgcaaaatgaagataatattcataactaccttatggagttgttatgctggttaagtgaattaataatatgtgaaacacttaggacagcttggcacatagtaaatgtaaatagtagcaactattatccctatcctcaggatttgggcctgagcacagctgtactgggtaaaacactggtatattagatacactagtcattccttgtgcagagttaagtattcctaagcctggctgggtaatatgtcagtttccattttcttcagacccctgtgggccctcatgaatgacaaattcatcccctaccctgatttttatggtatagctacattgggcaggacataggcaattatgtgactctgtgtaattgcatggtcagtccctataaaaactcagcaattgtatgttttgttctgtaaggtgtcatatagttcaaccttggtgggttacttttagatccaggctcataatcatgaagaggaagacatttgtcatacaaccactctctgattttctcgtcctcttggagttaatagttagccctattgccaaattgctgagtttctataaagatatactgttgaggcccacaggtcccaattttgacttgggcaaataaaagaaggccagtcctattcagcctcctgcagtatctaccatcgaggccagcaggccagtgcagtacaaaccttagtcatgaacataacagtatgtggtttactgggttgtttgtctcatgaggccaaacagaagctcccaagcttctgcataaatggctttatatcttccttttagggtagggaatgataagagggcaggttagaagcaaaatatgcttttatgagcaattgggaggatgttggagactcctgagagtttcctgtgtctcctaggatttgccactggaatgtcagcaggccatacctcaggcgttcagctccatggagcaaagacagtagtgatcacgttccttgacaacagtgctagtgtgcggggagcttttagttttccttttctctgctcctgtaagccccataataattctgtagcagacacaggaagcaatgtgtctaactactactaggcaatgtgttcttgggatttttaattctcaggaattcgcagccaattaaatgaatttactttgatccagttctcttttcaaggcaaaagctgtgtcatcttattgggagctgactgtgttaagtgggagggtttacaagataagaagaaaagacagtctctgccatacgtgtttttataattgaaatgggggaaatcgggcaggctgagagagaataataagaacacatgtgcacaggaatttaaaaatagcaccccatttaaagcaggttccagtagtcaccaggaaaagaagaaaggtggagtactcaggagggacttgtacttggttcagtcagggaaaggtaaaagatagtatagttatgttctcaattagacttgttccctggttaattgaagtaaagactttaatatctaattcctacactgcacagaagtatcacacattgaaacagtgtgacatgggaaggactcactgttaacgaaagatttagagagaatgaaaaaaaaagtaggatttgggtttttcagagttgaaataggttcatcttttctgctagctcctccttttatacatctccactgtcgttgctccttgggttttaaattcagggagaatcaatgagcacagttctgcgtcttaatatatttagggtgcagctgtttaaagagccaggattagaaaatgaatcgaacaaactaggattatcttcaacagtaggatgctgagctgtgtttgctgattcctgcttaagcagtcgggacagggcatccttgcatgaaattcagacatccctccctggcagcctctgtggtaaagtagaggttgcagaacaagtctggcagctctcagcccgaacccttgtaaacaacagatgttcataactaagttctagggtgggggtaggggttattgttgatgcttgaaattctttgaatttataggcagcatctcagggatttagcaaaaggaggaagttatacagaattgatttctgcagtgtacaggtagaaatgatgcctcatggatttccttgaagacaaagcacaggctattgtgtggactctaaaacagagcaaggtgaacccaggaaggcaggcacagttaagaaagggttggcttcttaggtgtattgacttcctcccctccttctcctctctcactcctttttatacattgactggatttgtcagtcttgttcttgctcctgttttctccggtaatgcgtggaaatgtgtgtcctttcttaccacagagtcctagatacatgtgcatacaaatacacagtgtattaggccattttttgcgatgctgtaaataaatacctgaggctgggtaatttctaaagaaaaaaggtttgattggctcatggttctgcaggctgtacaggaggcatggtgctggtgtcggcttctggtgaggcctcaggaagcttacaatcatggcagaagtcaccggggagccagcatgtcacatggtgagagtgggagtgagagtcgggggaggtcccagacttttgaacaaccagatctcttgtgaactaagtgagcatgaactcacttatcaccacagagatggtgctaaaccattcatgaaggatctacccccatgacccagtcacctcccaccaggccccacctccaacatttggaatcacatttcaacatgagatttggggggggacagacatccaaaccatatcacataggaggaaaaacacacaggaagagcacacaggtgcacttcccttagtgccctctgaaggacgcaactcaggtttttatgatatactgattaatgggttattgttatgggctttgtcttggattttaacctgatactttctcagtgttggttttgctagatgttcattacttcattaaacagaggtgccgggtgcggtggctcacgcctgtaatcccagcactttgggaggccgaggcgggtggatcacgaggtcaggagatcgagaccatcctggctaatacggcgaaaccccatctctactaaaaatacaaaaaattatccgggtgtggtggcgggtgcctgtagtcccacctactcagaaggctgaggcaggagaatggtgtgaacccaggaggcggagctttcagtgagccgagatcgcgccactgcactccagcctgggtgacagagcgagactccgtctcaaaaaaaaacaacaacaaaaaacagaggtgagtgatgagaatatggcttatgaagacttcagtgctacctcttcttgatccccatcccctagtccccaagcacacataccgagtttccagccagatgataagtgcttaggaaaccttctactttacagcatagttcagggaagccataatagaaaaaatataatacatctttggtaggcttccttggcaccaaattgacgaagactttagaaaggttcttatcgtacatcagatgaaaaaaagcgatttaccagatctgggaatgtttttgagccactctagcaaaaaacaactggcttgaaaatctttgataaaatcgcttattcttttggaagctaagaacatctttgtacaattttttgttgttgttgttttttgttttttgagatggagtctctcactctgttgcccaggctggggtgcaatgatgccatttcggctcactgcaacctctgcctcccaggttcaagcgattctcgtgcctcagcctcccaagtacctgggattacaggtgcgcaccaccatgcctggctactttttatatttttagtagagatggggtttttccacgttggccaggctggtctcgaactcctgacctcaggtgatctgcccacctcgacctcccaaactgctgggattacaggcgtgagccactgcgcccggcccatctttgtactattattccttctggaaaagaagtccacttctggctgttttgtccatttgtacgaatttggtgaacaccaatcctggtatgtgaggttcacttaatctttcagcaaacatttattgaacatttattctgtgccaagagttgtacaaggaattaaatatacatagaagaataagctaccattctagcccatgggagttattacttaatgtgaaatattttaagtttgtttatatacatttgtatgtgctctgataaggcgtagacttccaggttgaggagacagaattgttgggttatgagtcaccctgttagtcacctttattatatgtgaatcagtaataaacacttgacttcattctcatcgctaatgaccaataggttctctgcaggtttggggtcacaaagaggtgtaggatcctgttctttccctcaggaagctcatggtgtcatgtggaagacagagagtttatgggaaaaagataacacaaaataatatacacttactgccaaaggagagatgggagaaatgatttcatttttcttcagaatgcaatctgtaaacagttttaaaattttgccataatgttagacttacagaaaaattgcaggaatagcacaaagaatttttgtatactaccattttatccagattgccccaaaatgttaacatattactacatttgctttatacttcacccttttcatacccaattctcacacacatattttgtttttctgaaacacttgagagtaaattgcagacatgatgaccttttatccatacatactttagggtgtatttactaaaaataaggatgttcttttgcataatcgtagtgcagtcatcgaaatcaggacatacagattgatacaatactattatctaatcaatagacattcagattttaccagttgttctaaaaatggccttttttggcaaacgaaagtccaagattatgcaattcattcaattgtcttatctctttactttcctttaatgtgggatgatttccaagtctttatatttcaagacattgacgttggccccgttattttgtagaatgtcccttaatttgatatttctggcaatttctgataatttccttattattagattcaagtcacacacttttggcaggaataccataaaatgtaatgtcacgttcttctcagtgcatcatatcaggaagcacttgctgatgatttgtgccataactgatgatgttaaatttgatcatttggttacagttgtgtctgctaggtttctccaccatgaagttgttctataagctttgtaattaatgtatatattgtggagagatactttgagaccatgtaaatatcagcttacccttcaactcttatactcactagttttagcatccattataatttcttgcttgaatcactttctattatgatggttaccaaatagtcatttttccagttttcatcattccttctacatttatcagttgcaattctactgtaaggaagagcttttccatcacccccactttttggtctggttgttggtttatatcagtgtggacttgtggattattattttattcaacaggttataatcctttaccatctttattttaatgttcatattgttctatatttggccaatggagtcccttcaagctggcttctgtgtcttattgatatgtccccatcgttctttgagcacttccttactttatggcacaacaagatgttccaggcttaacttgtactttccttgcctttactgtggagttgaccattttttcagagagcctcggttgcttttagtgggaaatggtatttagaaaccatggatgctaaatatgctctttgtaactgaagtaccattatttatagtccctttcagcagacagaggtagtagatatatgtatgtacacatagacacatacacacacacacccatgtacttctataaatagctatttctttatctgtctgtatatttatatatattaaagcctatgagatcatatcagtatctttcattccaatccaataccacatgttttatttaattttctcccctttcctgttctctgaacagtgagaaacctggttcctattatccataacacacattttcacttaattgctcagtcctagagtgtacagaaagttgtttcagaattactaacccaggccgggcgcgatggctcacacctgtaatcccagtactttgggaggccgaggcgggccgatcatgaggtcaggagatcaagaccatcctggctaacacggtgaaaccctgtctctactaaaaaatacaaaaaaaaaaaattagccgggcgtggtggcaggcgcctgtggtcccagctactggggaggctgaggcaggagaatggggtgaacccgggaggtggagcttgcagtgagccgagatcgtgccactgcactccagcctgggtgacagaccgagactccatatcaaaaaaaaaaaaaaaaaaaagaattactaacccatgcctctgaaaaagaagactactgactagattttaatactggtttagagttctttttgttattagccttgagggccaagacacaatgttcaaaagttagctgactagttctttctttcctatcttagtctgttttgtgtcgccataacagaatacctgagtccaggtaatttataaagaaaagaagcttatttggctcacgactgtggtggcttgagagtataagaatgtggcatcagcatctgctcagctcttggtgggggccatgtgctgcctgacaacatggcggagaagctgaaaggctagggaatgagtgaaaagaaagcaaacactaggaagaagcttgctttacaacaactcactctctcaggaactaatccagtcccacaagagtgagaattcatttccatgagaatattaatcttattcatgaaggattcttcccatgacccagacaacccccagtggcccagcctctcaataccacttgcaattgcaatcaaatttcaacatgagttttggagggaacaaaccagattcaaaccatagcatccctcaacctccagaccttcaatgtagttatattatttgtttgaaatataatttggtttatttatttgtttgtatttaatgttttcctctccggaatggggtcttgacatttctcactgccaaaccttttctcttgactaaaaaagatggagcagattcaggagaagtgagagacccatgtatccatagattaagtcagggctttagcagaagtcagtgatggggacataggccagacatgcactgagaacaaaccaaccattttcccctacttctgggccagccctgtctctaagcaagccatcttatggattgagacccttgccagtttctcctaagcctgctcctaggttctccttgccattctccctgatcacctcttttgcatttagcgaaccaagaatccagcatcagcatcagcatcagcatcagcatcagcatcagcatctgctcagctgtaggccatgattgtctgtactgtttaccagcagctcatgtaatatgcttgatgtaagaccttaggataatgttgatctggcctttcagacatgaagccccggggcactgcacattgacacccaaacttgcaaacttttacgtccttttgcgagactgtttgctagtgccctgttctgaaatccttgaaatttctcctcctggactttcttcagttacatgctttggcctctctaatagctcttttgcatcaattctgatgacctggccattttctcctgtctgtctgggaatggcttccagaatccccttcctctgccccatttaaccctcttcctccatctcccacacactcattttatttctctttcctccagacacatataacctggtcagtgctgctgattccagctgttctgaatcttgtgtacagcttaagttcaaaaacagatgggcccaaagtatcctagatgctgtgccaatttccactgcatgaaaacaaattactgaaaagcatcaggaaattttagaatagttttggggtttgattctctatcttctcaatggtccttcctccccaactcttccatttctcttcaccgtccctgtccccccattataccttgccactttccatctcttcttcatattcctcacttagcaaaggctggtttttaaaacctttattctcatttttactctttctatgtactgataggtttaaccatcaggatgggactgtgttgataatcaagctagggctgttggttgtttttctagacgtttatacccttttaaaatcttccatctaggactagggaccttatgtccttatgtccttttcatatagagaaggtaaggctggggcctctgtgtctgtgggtacatttgtaggtcaaataattcaccagcttgcaaataaagtagatattcttctattgactttatcactggggggtgcacaattgtgccagtgccattgtctgcccttgtcgggagtgagtagacactccctgtagacagggagcgtgttccttggaaagcagtgacattggacccacaccattgctttcagaatcctcattctgggaatatgccaactgctttctcccagtgttctgtaggacattgtttagctttggcattcctagtcaccctaaaaataagaggaaaacaatcatcgtagttggaccacttatcttacaggtatgtaaggaagacactggggtcatttacagagcatggggagaaagctgttggcatggtacagtggttattgggtgcccactgtgaacagacattgtaggaactgtcttcaagagaagcccttgagggataggcttctagaagttcaggtacatgctggatttatctatgcaaattataatgtttccccgcttccctccctccctccctccctccttctcttctttagaagagaatcctcagattctcaaaaagtatcaagcagagtcctatggatggtaactgaaagaaaaaaagaaaaaaacgattctcaaagggatctggaatacgtaattatctcccataatttaagaccattactctggagcagtgactttaaaacattttgatcatgaatctctatattttatactacaagctggaatatacttatatacacataaatagctgagaacaatactttcacagaacaatacttatctttgctttgtgtgatgtactctgagattttctactttgttctgttattctttttttttgttgagatggggtctcactctttcacccgggctggagtgtaatggcgccatcttggctcactgcaacctctgcctcctgagctcaagtgatcctcccacctcagcctcccgagtagctaggaccacaggtgcacaccaccatgcccagctagttttttgtatttttggtagagacaaggttttactgtgttgcccaagctggtctcaaactcctgacctcaagtgatctgcctgcctcagcctcccaaagtgctgggaatgcaggtgtgaggcactgcatccaggctacttttttctgttattctcttctactgttgcctacttaattttttgagaaatgctagttggtgacctataagttgatttttttaaacctcactaatgggttgaatcccacagtttgtaaaacattgctttaagagcattgttttttaaattttttggtgtgcataaaattacctgacatgctgatttgaaaggcagattcctgggcatcagtccacccctagtaagttgtaatctctggcagacgagcataagaatccacattttaaacaagcattccaggtgattctgatgcaaggtggtttggggtcttgaagcctcacacttacagaaactgctctcttttgcatttatgaacctggctgttgaaggcttcagatcacatgcttggggatggtagatactagtggggatcatctgactccagactgggaatcttctcgttacaggatgaccccaatcacttaggtttacttctggatcttgataattccttgatagtcctcttttactgatgtctcttatggcccttaagaaggcagagaaggggttaactgaggccacagaatagagagagtgaaggaactgaagggtcattttacagagtgactggggtgtggcccagtcctccagtaggtgcccagagccagtccaaaattagaatggggtgggattcaaaactgcttttcctattcacttgcctttcatgtgtaaccacatgcagtgtgtcaacatgctttcaggcgccgttaggcagcagcagttttgctccctctgggttcatggacccttggtattcttgttatgtgttgtcttagaatagctctgcgctctggggctctgagcattgtccattaactctttcagcaccagccctttgagatgctaagggcttttgaatgaaatgtaataaccaccacaatgaaataagaaaacggttactagtcaggagacctggattcttgccctgctccaccactgtctgtgtgacctcaggctccctgagcctcagtttcctcactcagaaaatgacaggcttggtctagactctagaccatcttgaaagtcccttctagctctgaaattccatgattctatttttgtacactctggccttttctctttgcacatgattctttcgtttaaagtctcagctgcattaggcacagaagattcactgagtttgggaatttccagagaatcagatgataaattaatagcaacaaaatgtattcctggccaggtgaggtggctcatacttgtgagcctggcactttgggaggctgaggcgggaggattgcttgagcccaggagtttgaggctacagtgaaccatggtcatgcccctgtactccaacctgggcaacagagcaagaccccatctctgcaaaaaaaaagtatgggccgggtgcggtggttcacacctgtaatcccagcactttgggaggccaatgtggacagatcacctgaggtcaggagttcgagaccagcctgaccaacatggaaaaaccctgtctctactaaaaaacacaaaattagccgggcatggtggcacatgcctgtaatcccagctactcaggaggctgaggcaggagaatcgcttgaacccaggaggcggaggttgcggtgagccgagatcacaccattgcactctagcctggacaacaagagcgaaactccgtctcaaaaaaaaaaaaaaggaagtgttcctatttagtatactaatgaagtagggaatttatgaaacaagtttattataaaaggaattttgagatgtatttgtcttttcagacatgattctagtcactttgttttgtgggtatgaattcattgtgtgggctgttgagtaatgatagttgtcataattataagaaaagatgttgatactgatatatagttgtagaacactttcatgtttataaagtttgtttaagggcatcaccttgtttgattggatcttcacaaaagtcatgtgtgttaggcagggcaggtctgctgtccctgcttatcccatttatttatttattttttatttatttatttttttaaaagataaacagttattcatttttgtttaagacatcaggagtactaataaagaaccaactggtaaactgctgataattccatataatatatctagcactacaactacactgaatcattcttttttttttttttttaatactttaagttttagggtacatgtgcacattgtgcaggttagttacatatgtatacatgtgccatgctggtgcgctgcacccactaactcgtcatctagcgttaggtatatctcccaatgctatccctcccccctccccccaccccaccacagtccccagagtgtgatattccccttcctgtgtccatgtgatctcattgttcaaatcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgcgatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgcagattctggatattagccctttgtcagatgagtaggttgcgaaaattttctcccattttgtaggttgcctgttcactctgatggtagtttcttttgctgtgcagaagctctttagttttatgagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctctttgttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacgaaggggttttctagataaacaatcatgtcatctgcaaacagggacaatttgacttcctcttttcctaattgaataccctttatttccttctcctgcctgattgtcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatagtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattcagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcatgttgaattgatccctttaccattatgtaacggccttctttgtctcttttgatctttgttggtttaaagtctgttttatcagagactaggattgcaacccccgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacatttttcccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcctcactttcaggtacaccaatcagacatagatttggtcttttcacatagtcccatatttcttggaggctttgctcatttctttttattcttttttctctaaacttcccttctcgcttcctttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtgctcctgtagctcagagtaatttgatcgtctgaagccttcttctctcagctcgtcaaaatcattctccatccagctttgttccgttgctggtgaggaactgcgttcctttggacgaggagaggcgctctgcattttagagtttccagtttttctgttctgttttttccccatctttgtggttttctctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctcagatggaaatgcagaaatcacccgtcttctgcgtcgctcacgctgggagctgtagaccggagctgttcctattcggccatcttggctcctcccccctacactgaatcatttattttgagccagggcttgaagcagacaatccaagcatccttctaaactatcctcagtcttgtcaacagctgttatcttcagcttcttcaaggtatcactgagattatccatgttgctccccgagggcgaggaaccggcggggcgaggcgaaggtctctggtgcgggcggcgcggctctgtgtcctccctctacctccgtctctatttatttattttttaagagacaggtcctatgttgcccaggctggtcatttacaggcacaatcattgtgcactgtggcctcaagctcctgggctcaagcgatcttcccacctcagcttcccgagtagccaggagtacaggcacgtgtcaccatacctggcttccatttactttttaaaacaggtgaagagattttgagacccagaatgcatttgtgacttgcccaaagttacctggctagtaagtggcagagctaagcctagactctgggtcttaagcatagttcaaggcgctttccacagagtgtagatggagtttcacatttttcatccagattccttaaggacctgaacttgctaatttgatctactaacctggaaattgactagggcttctcttataccactcagccctttaaagttttgccagtaaagtatcaacatggttaataatatgctgtaatttagagcacacaagccaatggacatacaaatttggtcattcagtagccacccagagagtgagcacagatacacactggagcagctgatttggcaagattggtggaggctgaacatattaactagtcattaaatgaatcatggtctttctgtcctcaacatttacaggattgctttggctctggcatctgttgttagtcaatactgattaaggacccacctattcttggtgataggtgttcattaaacattctaaatataccctgtcctcaagagaataccttactgggcctgggggttgttcctcctgcacccccacacaaaaagagacttccttctaataaaggcaagataaatatccaaataacacatgagaactgataatgacacatgcagccaatctgatgactgtgtagacttcattccatttagatctatagtttcacagaatcaagaattttatttttttcccctccttttcattgttgttatgagccatgtaaggggactcattgtcccagggacgggtatttgggagggggagatctttatggataccctttcttctcagtggcttattgctatttggcatactaaagtacaatttgctagccaggaggagtttctggctgtagatcaaacttctccgctcatgcctggtgccagagagatgcttgctcttaagggggtggttactgctttgataataagtgtgtggatttctgagtgacgtcattccactttggcacagacaggtatttatttctctagaatgaactaccaggggtgagccagactgtctgcctcagtcatttcccaaggtttcatttattttaaaaatctgctaacacatctgtgtgtatttttttttctctgtatgtttgtcaagtgctataattacttatagggcttctggtgacatcttaattaactagagaagaaaaaatcaaagatataattgtagagttgttcacaggtttttctatggactttgtggatccaactgtcaacatgatattgatggttacgaattctttttaagctgagaaacgtataaattttatgttcctcggtcattgatcacacctttgttctgtcttttacccttgctatggtgttttagtttaactgagtgaatgagtcagctcaggcctttgatgtgatcacagcctattttggggggctttcagggagcatatttaatacctaagtgcatttctaggcccttagttctatggattatattggggtggcattgtagcatgtagattgtaccaagagggtttaaaagcctctttattcattcctccctatagttctgggaatgctagtgctaacacatgggatgtaaacaaagggaaggtcccaggtctacagaagctatagagggagctggtgggcaggcagattttctaagtcagccaaatcagggttttgcagtgggttcatccaagccaatgtacacacaagccacaagaccaggataagatgtgggttgtggctgatgcacagtttaggagcaggaaagccatgtcttggatccaggaagtctgcaaacatgggagaagcaggtcagaaaaaagaatgttgatcctgttattcctagaatagtggctagcccataataggaggctcaattaatatttgttaaatgaatgaatgaaataagaagacatcagggactcagagaaggagcctggacaataagatatcagaaactaggcaagaaatgtggatggcagagattcaaatcttgtgtagacccccgtgtctggtcttatgggatccatagatctatcttaagagatatgaagaccctccatttgcctcctttctgctgtgagcaccgtgccataggggtggttgaaaggaaggcagaatctctcacttaacataaattgatggagacatttccagttagtgtctacgatagcttaaatttggggaccattcctagttctctgacctaacccacaagaaccttggtcctataatcattcaggaaatcgtaagcacttaatagatgtcagacatggtgctagtccagttctctacttcaaagcagattcctaaggtccggctcttgggcatgctgttctctcaagggtgtggttctgctccatggaactaatccagagccacaagaatcttattttcatacagtccttcccccaaacctgattataggggacaatttaggctattttgagaaggtgggtctaccactgcttgaatcctttctaatcatctgtctaggctaccgaagacaatttgtggtactcacttgtccctgaaaatttgaaagttcatttctccatatgtagactatattatttttgcctttggcacttttctctgtctctgaactctcctcctctgatctcattgctggcaacgctgaagccaaagctgtgataagcccagagaagtgtgcccgccccctgcctgcccgtctgtctttgaaagataccttcaggctgccgctgtactactgggtcacaaaaccagcatccaccattacaggcagaatcgttttcaagtcatttcctaccttggtgatttttaccccctccttcttttaacaccttccccagcaaatccaatccatcctctggcttatctgggtcagcaagggtctgattttatgcatgacactgtcagaccataaatccgctgcagctttgcctctctatccagcctgcctgcttctgtcagcatcagcaaaatgcataatagagaaaataagccagaaaggctaataacactcatctgaataaaataatctctttggctgcctcagttcatttcattttaatcaaggtgccaggagggaatttaggttaaaaaatccagcctccttcttgtcacaagttccctgtccaaccatcacttaaatgattccttttatcatgcatgtacctttttttattcaccacatacttgtatgttcaataacatatattgaatgatgtatttaactctttaagttttgtctatcatcacagataggtctgtttttaaaagcgagaaattatattctgcttagatgtattgatagttgccatctctctatgcagattggcaggtttgataggaattctgagacaggggatgggagcttagtataagttgctgaagcatctagggttttggcaatctgtgctccctttggattcctttctgtcaacctcagcacacagttcccagtgtggaatgcaggactgattgttctaccttgtcccttagggaaaggacagtgggagattaaaatctgctctcctgttggtatctctctcacgtcttcccagagccttacggctgctttgttaattgcctgttgctgctgtcttactcaaaccattatttgctgaaggctgtgcattttcagcaggcagcaatcttggccctggcccagagccgggtgagaagcatgttggaaattgatgaaagctgagtcctagtttgtttggaaataaaaataataatatttcttcacatttgtatagtgctgaactattggcatagttcttttgcatccatcatttcatttgatccacacaacagccctgagaggtgagcaacttagagactattggcccaaaaggaaacacacctcgttatagcaatgcagaagctcaagctatattccagcaatgccagcctcatgccatgcattccatctgcacagccatgaacgtagcaattattaattaaatggcaccttaggtcaggagagcgtctaggattttacagccatactttgaagatctttgaggagtgagatgtataccaatagggcacgtgtccattttatagatgagatgataaaaaccaaacagaggtgatatggaaaagaaccataatagagaggccaacttggacctttatggacttggctcttcaccatggatattttagagaaatccctttaagcgcttgttgctaagtttgttgaacgtccataaatagtccaaggtgagggagaaaagctggtctaatgtcttcgaagctaatgattcagctatgcaggtttatctctttcagtgcatttacagtgataatgtcttctgcagatgtacaggcagcatgtgactttccgggtctcctttcgactccagagtcattccctctcaagtacagtatgatgttttcttgatcttcctcctgaaaaacattttaagtaagaaaaatactcctaggtattttgtctgctttttagggattagtgtttgaggaggtttgcagctgctcagcacattcctaagggatgcagaccctttcctttaaaggcccaagtattatacaacctaaggctctgggggtggggaaagtaaagagactgtgcaaacaaatgatagatggaaaagatataaagacaaatttcaatctcctaaccaaacgaagttcccttggcttcagcggtcccaaataaaatgaggctgcaaagcttctggagcaggaaaccactctagcagagccttaatatgctccctatgaaatcacgtctcgttgccgtgcttattttccagcctgaagtgtgtttcatctttgttcgtgttggctgggaaaattgtctgtatatttgtgatcccctcctcccactttctctctaccttacttgctctaccactacccaaaaataaataaatgaattaattgaaacacctcagttgaaaggaagaatatgtctgagaaagcttacagactcaaaggaccagaaatattgtgtgaaaagctgcattaatagtaggagaggctgagaactcctggaagaaacagccaacaggatctagtgctggttttttaagcatagactccttttttaaaataaaaatcttgcatagagcctcaatatatgaaacagatcaaagcagtatttttattggtataaatctgcttttaaagtacaaatttatagagtacttattatactgtcagtcaatgagaacaatgaggctgttttcatgaactaaaaatattgagatcaggattatgaatcagttatagttttatattcatttcagcatctggttttggtttaggtagtcagtccaatatcaagaaaattctgattagcatagataagttattgtaatcttgagctttaaattgatttagatggaaaaaagaagatatttttgttttaaagttgagtcactatcatcacctagcagctattccccttcataaatattaattggataagccccaacatgtataataggcatcgcaacaactgatgatgagatggtatgatattaagcatgttgattttcgctacccaaccacggtctaacatgaacccagcctaggcccttgagccttctatggcatgtgattgaaccttgctgctgtgtgtcaagttataggctcacctgtacagctttattggaggaggcacacacaggcttgaatgaaaaaataaacctatgcaaagctacatgtattctaattaatagcatattgttcagaagttccaaggcatacagtgattctttcttccagggtttacataaaacaatgctagcagcctgcgagacattgcagtggtatctaatgcagggagactgggtcctgggtctcttgctcatgtcagtgagggttgctcatttgaatggatgtgtcaccgttttttaaattgaaatgtgattttctgctaattccagagtatctcagaacacagtttaaaagctcctgctctctgaaaccaatactaatactgtaactatcgcacaaaatgctgtaaggatggaaataaatacatgtgaaaagtacttatagcaccttgcaagttcttttttcttttttttcttttgttttgagatggagtcttgctctcacccaggctggagtgcagtggcatgatctcagctcactgcaacctctgcctccagggttcaagtgattctcctgcctcagccgcccaagtagctgggattacaggtgtgcaccatccacactgaggtaattttgtatttttagtagagatggggttttgccatgctggccaggctggtcttgaactcttggtctcaagtgatccacctgccttggcctcccaaagtgctgggattgcaggtgtgagccacaccttacaagttctcaataaaacttattagcattaagtgataaggcattttattttaaaagatttctacttccagccatcctgtttattgacccatctttgttcagtcatcttttcttttgaggacaccctgggaatatgtgctctgcatccttttccatggtgttaggttgattttgcctcctctgcttcctcttttgatctgcggtctacctttctgagctagctggccttttgtttgtaccaccattaaagttctactttactataggtctttctttgtctcccttactatattgcagcatttgcacttttataaccactaaagcacctaacaccatgccttgttcatttaagatacaaatgtgtgtacatttgtggaattgaattgtggcattatttgtgtgtatgtaaagtgctatagggaaagaaccagtatagaccccccccaatccatcttctcccttaagaaatagattgaaaccagttgtcaatgtaaagtctcatgagatctgcccctttaaaaagcatgcttactgaggacatgggtatcttgccgagagacaccacttgattaaaatgtaaattaggttatttagaattttgtaactgaaatctaattggaatcattttgaaagttttcttgcaatggaaacatcagatgctatggaatgcatgtgttcaaatatcttaccattttgaatttaggattgtttccagttcacttttttttccccagatactaaacattttgaaaggagtaaattaattatgtgtctctcttcctctcagctggtatatttttgatttccatagaaatctttcagtttccctaaaaaggtaagtgttgtcacagtgattggcacgcttaagagttagtgattttggctacagaagagtgatgcctggggcagggggtgagtggtacctggatataggtttagaacagtttcaatttggactctaatattaattggtttgaagtaacttcttggttgggttagacagatatttgatttgtctgatgtattctgaagtccaagtaagtatggcatgattatttgttaatagttactactatagaattggaaaagccttctaagttgaacttcatggtttacaaatcacaagtgcctggcctttagtgctgaatggaggcagtactgactcaataaccaagctactctcaactcactttctttgtagtaggagtctgactggagcagggaagagaggaaagggggaaagaaacagatagttattatttgcagtgaatgacagtactcgctttgcagttataggcttggtttgaattctggaattgccgctttttagctatatgaccttgggcaaagtgtttaaaaatttttagtctacttttcctcatctgccaaatgtggttaataacacccacctcatcaggtagttgtggggtttaagtcaaacaacatgtataaagggcccagatatgtgtacagtatcccttgataaatagtactgcaaattattcctacttttgtttctctccttaaagaaatccaacttccaaatgtagaactttctgttgcttaagttaatgctgagttggtaatcaataattcttttggatcacaatgttttcattagaaatgagcatctagggctgggcgcggtggctcactcctataatcccagcattttgggaggccaaggtgggtggatcacttgaggtcgggagttcaagatcagcatggtcaacatggtgaaaacccatctctactaaaaatacaaaagttagctgggcgtggtggcaggtgcctataatcccagctactagggaggctgaggcaggagaatctcttgaacgcgggaggcggaggttgcagtgagccaagattgtgccactgtactccagcctgggtgacagagtgagactttgtctcaaaaaaaaaagggaatgagcgccttggtttagcactttactgctccactcaagctgtagacattttaggaacgcatgttcaggtatggtttgtgttcttgattgtatgggacatgagatcatggctcaataaatgaaatcaaaacttccttagatgtgttctgtggaactccagagttttcagtaacattttaatggcatatgtctccaaatttgcctttattaaatcctacaatggatacatttgtggggattttgtagtgctgtagtgatttttgtctctagacaaaatctctaactttggtttctaaccctagagacaaaccaaatgacttagtggctaaaatgatggacttcagaatcaccttagacctggtctagccagacaatgcagaactgttgttctagtccctggcgccctcttacttgttgtgttagtcttactcgctgtagacaagtgacaacctctctgagcttcagttttctaatcagttgaagggggataatggtagttctttccttaaaatgaaatgatagagcttagatgagatgagataatacgtataaagcattcaccaagttcttagaacatagtaggtgcctaacagataatcctgtttctccttgcacatcccctcttccctccctctccttcttgtccttattttctccttttttctccactgagtttttagaaaaggagaaaactagagaggtgagcttcaggaaaaatatctttatttctggattggctttgattgctgtgattttaggacacggactatagttgtagatgttgccctggctgcgtatcaacaatgacttcttttccttgatgtttcttcacaggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacagagatatttctagtcacagaggttcttgggtggagcaatgacacaatttttaaaatcctattagatattatgttgattacctgggtgacaaaattatctgtacaccagacccccatgacatgcaatttacccatgtaacaaacttgcacatataccccccttgaacctaaaataaaagttggaaagaaaaaataaaagaaagaatatcttattggcccacttcataggctttccactagtcattccctaccacatacttgcggagaaaaaaaatatttgaattggcattcctttcttcctttctgagctgaattaatagtagccttgggaaaggaaccatttgcaaggtataaacccagggctggtactataattcataatctgcatctattaacaaaaactgtgttttgggaagttttcttaaagtgatttgtgaagctgttgagcttaaggggccaacactgtcattttatgttttcctattctagttcatttagcaaactcatatacgtttatgtttttagtttagttttcttcccagggtcttatcttggccaaggtagactcaaaagtgtggttattcttatcgtggtatgtctttgtctttgggtctctgaatgctttcggaactcaattgttatcgtacttccttgggtataggttgaacaatttgacaaaggaaaactcaaaataatcatgataatcttaaggagccaattcaccttacctgtcaacgatggaactagcctcttgaaaatccaggaagctcttttctaagctgtctcagcttgagctcaaagtggaatcatttattcatgaggttgggttacagacagcggtgaaggccccaaccattgtatatgatatgccatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggattgtagtcgatacagtcaaagctcttgatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggcttttattagtagcccggctgtgctgtggttggggccacacctcattttggagtgagggtacttctcaccatctcctccatggtttccagcatcagcttcagcttggttgtcattaatttgaattattctgcaatacttggtgatgcatgtgtgtgactaaaattaaaacctatttaggtgaaattttgacagctcgtctctatgaccttgacagccacttagactatctcaagaaggaaagggcttgactgatagtttcctcctccgttttctttgttcatctgagaaaacaacttttataagatctgttcacctagctagacttcacccagtctctcagctccctttttaccaagccttagaaggttagagaaaaaccaggctagataatttaatagcctctccagatctcagagatgcttatactgaaggcagccagatagcaaagtcacgagtgttcctggctcttcaagtgccctatgcacatttcaccaaaggtaggtacatggcatgtatacaaggtgtggggcatatgacatccatgaagaaaattcgtctgtgaatgatattcctagccatgggctcagggttgacttccttaagccgtgtattactatgctagagcgtgaggaagaacttatttctcataggactgtttatatattacatttcactgaagaaaagtatgcctattataatttaatagctatatgcattttcacaaactgaattcacacttgtgtaaccagcacccagatcaagaaacagaacatttctgtaccctagaaaccccctcatattcccttctagtcatctccccaccctaaatccccaaggataacaactgtcttgacttttaacagcagagattagctttgcttggtttcatactttatataagtagaattgcacagtatgtactcttttttgtttggtttctttcaatattatgtttgtgagatttattcatactgttgtgtatagttgcagatcgtaggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctgggcaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgcactccagcctgggcaacagaacgagaccctgatagtttgaggatgcagtgagctgtaatcatgccactgcactccagcctgggcaacagagagagaccctgatggtttgaggatgcagtgagctgtaatcatgccactgcactccagcctgggcaacagagagagaccctgactcctaaaaaaaaaaaattgattcattctcttttggctgggtaaagagcctctctgctttctagtaatgggcaaacaaacattcttcataccacaccccagttttttaacctcttttgtttagagtgtcgttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttgttaaattgtgataggtaaattgtaatcccacagataaggacaaacaaaagtggatataggtgtggagagggctagcttaagcaaatgaagaccagatttcttgaagaatgaagcattatttcaggtgctgatatctacagtgtcagcaatgaagaaataccaaattgggatccaaatacataaaatagatatgttttaccagtaaatttggttccagtggcaaaaggacccatttctctggggacataggcttagaaaagataccttaatttgtggtatggctgtacacacctgtgctttatgtgaatttgggtctgtttgtcactagcaaaagtcatttttaaaaatctttttttaatctataaaacttaatgattcactgcaaaaattatgataatagaagtcattatattttgaacctctatgtgccaggtattgtgttaagcactttatatgtattatctcctttaatccttaccataattttataaagtagttactattgtcatcatcgctgttttatgaaggaagaaactatggcttaaagagattaagcaggccaggcacagtggctcaagcctgtaatcccagccctttgggaggttgaggtgggaggatcgcttgaagcaaggagttcaagaccagcctgggcaacatagcaagactctgtctctacctccctcccccacttaaaaaaaattagctaggcatggtggtacacacctgtaggcctagctacccaggaggctgagacgggaaggatcacttgagcccagaaatttgaggctgcagtgatctataatcatgccactgtactctagcctgagtaacagagccagaccctgtctgtttaaaaaaaaaaaaacaacaaaaaaacaaaaaacaaaacagagggctgagagcggtggctcacgcctgtaatcgcagcgctttgggaggccaaggtgggcagatcacctgaggtcaggagttcaagaccagcttggccaacatggtgaaaccccgtctctacaaaaacacaaaaattagccaggcaagatggccagtgcctgtaatcccagctactcaagagattgaagcaggagaatctcttgaacccgggaagtggaggttgcagtgagcagagatcatgctgttgcacttcagtctaggcaacagagcaagacttcgtctcagaaaaaaagaagagagagagagattaagaaaaatgaaatgaagctaatgtttaactccagtcacctggctctagaatccaacgttttcatctacatactgtattaggattctctaagtatgttgtacagagaagagaaaatcctggattttctctgtttcattgaattcagatatttcacttagttatagaattaacctaatttttcttttgcacataaaccttcaaagggtatggagatgttgaacatcaacattggattgtttttcctacctggggttggggcaagcagctggaagttgggaatgaaatagggcagcatgtttatactccccaggggcaaaatatctgtgccccctgtaagagggaaacaaggactcattaaatgtgagaattggccccaaatctggctcacagctaatttagctaatttagggatgtcagggtggctgcacaattggcccctctatgctattgaacccccttaagggaggctccttgctagccctctggtttgtggtaatgtctgctggtacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctgttggaaccagggtttgggcaaatattattgctgccaccttcatttgtttaatgcggtggcttcaaaaaccatgggcaaaaactgccaagtttgactcccatctccctgtggtctccatgaggggcatgttctaaagaagcccaccaagaacagaaataatttttcccacttgcttagtttaaactgaaataaacttgggtgtgctttttcctacaggagagaggataatcctgttttctctttttacttagctggaacacactaaaagtacctctgactttgctttctcaaatcactgtttctagcccttcacagctgctcacacttaagcttggaagctggtcagttcagacagtgctaaggctcagttgcatccttatttttacagcactgcagtgaactgtactcctgttttgctgttaggactcttaagtttctatggcaaaaatttaggttaaattgaaaaagccaagtcagattccctatagaccagtagctttcaactttgcctgggcatgaaagttacttggggagttttaaaaaaatctttgtgaccttgaataaacaaaggtttcttagaatataaaaagcatgaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatggcattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaaaaaaaaaagaggtccatattctaacctttggaacctgtgaatgttaccttatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagccagtgaatacagctctagatgctggaaaaggcaaggaaacggattcttcctgagagcctccggagcagaagcagccctgctgactcactggtttcagcccagtgaaattggttttggagttctgacctccagaactctaagagaacaaatgtatgttgttttaagccaccatgtttgcagtaatttgttacagctgccttaggtactttattcataatagcccaaactggaaacaacccaaatgtccatcaacaggtgagtggaaaaacatattgtagtgtatccatatatcaatactactcagcaataagaagggaaatgctgatacaatataaatgagctcaaaaaacattatgttgataaaaagaagccaagcacaatgagtacattctgtatgattctgtttctataaaattttagaaaaaacaaatctgatctatagtgatagagaatagatcattgattgccttggggccaggatggggatgaaggattgactgctaagggacacaagggagtttgtagggtttttatagcctacattatataacattttaaacaatgctttataacatttttataatgttacataatcttgaccatggtggtacattagacagactttatcatattatacacttaaaatgtgtacattttattatgtaaattatgcctcaataaagttgatctaatttaaaaaatactcatgccaagaccctaccccagcatgatttagtcagaatctctggagtagggcctgggtgattgttgcctacagctagggctgagaatcactgctgcactgttttccatcttggggaaactgcagagcacagagaatatctgatgccctaagatcctgtctatctgtatgtgagccatgtttgcctctgcaacagacagtgttaaagcatctaggctagtttctctaggcaacccattgtggtttcctactttattcttggagggtgatgaagggtgaagttagcttcagataaataaatctggtgacaaagggtgaatctggcttccttcacactgcaggaagtggggaatgcaagaagagtgctgaggaaggaatgtaagaggctcagttaatacttttctccagggccttggagatgttaaacatgtccttttgccattagtgaatcagtcacaagagaattgccacaacagtcagatttcttttggcactaaggaaatgaatctggtagttaaaaaggataaatgagatttaaaactaaaagcagtgcatgttacctatctgtttggtatccatttggactgagataggatttcctatggcgtgtcttgagtccagctgtttggcatgtgtgagaagagtggatgatgaaactgtgagagggcattttgggtggtgtgatggtcataaataagaagaggagaagtggtgacccacaatgctggtatagttgaatgtccctggtaagtgctgtggattgaatgaatggaggaaaagaatggttttccaaaggttgtgtccctgtgctctgcccccttaagaaagggtttaactctttgggagaaggagtagatgagtgatttaaccctccctcccttccccgtctaccatatccctcctgctcgtctgaactcagtatctgtgattggactgaatttcctccacattatagcatggtcactaacagcgtttgcacagtgctttacggacagctgttccagttgcccagtttatcttgttggtagcaaaaatctgttctaattaattgagctttattctctcatatctgatgaaaagatcctctttggagaaaagaatagaatgtgaagctgagcttatttgagtaggggatggaaggctgccagctacttcaaaggtatctctgctgataaggggcgtcaggtttgctgccaaagccaacaccgaggggagctttgcagctcgtgctgttgggggtgttttagctttggtttctgtgacactgggtcagcagcatctgtgtgctctcccttgaggctgctctctgggtggtccaggcttttatttagacttcggaaggtgcagctcaaagggaatgtgtgcatcaaagatgtctgtagtcttttgcttaggttagtttgtgtgtttgcctttttggtgttttagttcttaggtatctaccttttctaaaagagctcaaggtgctatatttagaactttcaaaagtataatagtacttcgatttgtataaatcaaaggattattaagggaatctgaagacgaggaatggaatatgggaaatggaatatgggaaagagaggtgcagtagacaaaaaataaaagtgtccatatgcaaccttgtattggaatactaccctaaattaggagattatacagtcaataagtattttagtgaatactgcatgcacagcattatgctgctaggtgcttaaaagagcttgaaaatcaaattgaggagtaagatttgcctcccaagggagcttggggtttttggtttatttaggtctctcaaaactttctgtgggatgatgatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttagattcttattattgcttacttgtatgtaatatatcatctttttgtttgtttgtttgtttgttttaaagagatggagtctctgtcccccaggctggagtcctgttgcatgattacagctcactgtagactcaaacttctgtgctcaagcaaacccagtccttccatcttggcctcccaaagtggtgggattacaggcgtgagctgccatgcccagcccttctttatttggctgcttccaatatttattcattatctttggtttttagttctttgattatcataagagtgtaagcgtggttttcattgtattcctttggcttggttaaatataatatccagacaatccctgatctgtcaaatatctaatttgtagaaattgtaggaaaaatatcaattttttcctcaatttgagaaaaatttttggcaaatatttttttctgtcccatctctccttcctgttttgctttgttatcaattgcatgtatgttagactacttgattcagtcccacagcttgttaatattctgtccatttttttcaaatttttgttttctgtatgctttagtttagatgatttctaaagtttaccaatttggctgggcatggtggctcacacctgtaatcccagcactttgggaggccaaggtgggtggatcacttgaggtcaagagtttgagaccagcctggccaacatggtgaaaccccgtctctactaaaaatacaaaaattagctgggcatggtggtacgtgcctgtaatcccagctgctcaggaggctgaggcaggagaatcacttgaacccagaaggtggagtttgcaggaggctgaggcaggagaatcacttgaacccggaaggtggagtttgcaatgagctgagattgtgccactgcactccagcctgggagacagagcaagactccatctcaaaaaataaataaataaataaataaataattaaaacaaccaattctttcttttgttcacctaagatgctataaatgccatccaatgaattttttttatttcagatttttttttttttttttttgagatggagactcactttgtcacccaggttggagtacagtggtgtgatcatagctcaccgtaccctcagactcctgggctcaagtgatcctcccacctcagcttctcatgtgtctgatactacaggtgtgtaccatcatgcttggctaatttttttagagatggggtctcgctgtggtgcccaggctaggcttgaactctggggctcaaatgatccttccccttcagcctcccaattattgtatggatatttttaaaacatagttggcaattacttaaaaatccttgtttgctatttttaacattgacattatctgtgggtctgtttattgattttcctcttgacttttttttacatgcctactaatcttttattgcatattggacatcatagataatatgtcatagaaactctaggtgtacttatcttcctctgaagagtatgaagttttattctaggaggctattaaattactggttgatcaccttgatcttgtgggggcttggctttatacttcattacagtgggtatattttggttttgcccttcgtcttagaaaatactgtataattaaggcatggcctttctggggttttcatgggaagcccaagatgtttatcaagcccctctaacttggcaggctttgaatgccaaattctatcttccttacagtgggcagcacctaagacgaccaactatcctgtttgccttgggctgagggggttcctaggacatgagacttttagtttatctgttcaattgttgatggcatttggatagttttcagtttgaggctattatgtatgttataaataatgctgctatgaacattataatgggaagttattctttccaatgtatggttgaacctggtcacaagccaggctttaagaatagtgaattcaaaaccttttctctctctttctctctctctctccttctctccctcctctgtctctctccctcccccccttccttctcccctctgccttctcttccctctcctttctctcttccttttcctctttccttctccctctccttgtttcctccctcccttccttttctctattcttttgaataatcttttaaattttatagtagatgtatgttatagaaaatttaaaaatacagaaagcaaaaatatgatataaagaacagatttattgtacatactattttgtaatctactgttttagtcaagaccttctcctttacatttcaataaacttttgtctcatctaatacccaggccatgttaaagatttaattaattactcaaaaaatctctttgacaactagtttgtccaagccagtatctaatgcacacagttttatgtcccttaagtgtactttaatctagtattattttctttccatgaaactgatttgttgaaaaggccaagccagatgtcctgcaaaatctcccatcttctagatttgtttggttgtttacttgtgttgttaagcttctgcccgtatcccatatttcctgtaaattggaagttggttctaaaggtccaagtggattcaagtgacttagaatgcataataagtgatgttagtacttcatgtagcatcagagcaggaaatacataacatctagttagtctaccgatagtgatgctaatattggcaccctctagaatagggctgtgatagtctgacccttccattttctagttacattttttaaatcacatgatagaaacctgattgtaaggtgttattcatggtgccagcctacaaatattgggtgccagttcagtcattcgtctgataattttagtatcagttgataattttagacaagttactttttgtcatctttgtacctctcttacttgactataagatgcctctctgaggctgggcacagtggcttatgtctgtaaccccagcactttgggaggcggaggcaggtggatcacctgaggtcaggagtttgagaccagcctgaccaacatgctgaaaccctgtctctactaaaaatacagaaattagccaggcatcgtggtgtattcctgtaatctcagctactcaggaggcttagggaggagaatcgcttgaacctgggaggcagaggttgcagtgagccaagattgtgccattgcactccagcatgggtgacagagcaaaactccgactcaaaaaataaataaataaataaataaaataaaaatgcctcctgagaaaaggagaggattgttaatacagctcatcaggcaccatgcaaatagtagtttgtaaaaacgtattagtcttgggagaaaccacacacacgaatagtgtgcaagctgactaggtgtcaatttgttattattaagaatcacagcaataatttttttaaaaaaagcataattctaaatgaatgctaaccatgcctagggactgtgctaggtgttttacatgtattaacctatttaatctcatcacaacgacactttgagatgagtactggttttatcatccccatttgtagataagagcatgggcaaagggtttaagcaatttactgaagattatacagctggttgatgggagaaatgggattcaagcctaggcagttggcttcccctgatctcttcacatcatcatgctctgctgccttgcatgtaggaaggtggcagtcatattggtaagctaaagaaccagtgcttgtgcagggaattaatgactcatgcattctgcagtcatatgttgctgtgcttctgtcaggtcagaatttccattgtgctattctgattctgcttcttgcccagcttgtccagagagagagtagcacctttgattttagcctcccttgttgcaggacaggcttctgttgactcccctatttatctttgtcaagacttttcctttgaattcctccctgcttgtctgagcatgatttttatttaaagtgaggacaaaatttaagttttcctccttttgacacagcgtcttcagttttttttcattttcatcttctttccttacaatactggactttctctggtcttttagtttttctactagatcctacctttctttgcttttaagcccagcccttggggttttttgttttgttttctttttttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaagttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttttttatacacatttttttaaaaatgagagttacattatatattaagcttagtgtaatttttttcatttaacatttggagaagcatttttatcatgtcattgcatcttcttttaaatgttgcctatatgatcatacagcagtctgtagtctggctgtcccttaggtttttcatatattccttatggttctttggctatgttgtctttttttttttttttttttttttggagatggagtttctttttttcaggctgaagtacagtggcgtgatcttggctcactgcaacctccgcctcccgggttcaagtgattctcgtgcctcagcctcccgagtagccgggattacaggcgtgggctaccacatccagctaagttttttgtgtttttttagtagaggtggggtttcaccatgttggccagactggtcttgaactcctgaactcaagtgatctgcctgccttggcctcccaaagtgctgggatttcaggcgtgagccaccacgaccagctggctgttgtcttgactctcccctggactatgttcttgtacatctagaagcaattaaaaatctcattgttgtctttttggaaatcacttgtttttaggatgactaggtagccaaggctttcatttggaaataccctacttccatttaatataaggtaaggagagagggtttttccccctgctgctttccctttttcttcctcttctgtcttgctcattgtcttagagcttagctgagaatcagtgctacgcctgagcttgggccctggctggctcagtggagttctttcaccatgctgagtttcactttcctcatctttacactaatgaaattactcataccctcactgttccttctcagaatgctataggcatcagtaaaacctgggaacaaagtgctctgcaaagttatgttatggtcagaaggtatctggttgtgttcatgcagaagagcgtgtgtcttgtgccttcgcccagctagggtggtctttgcaatctctaagctaatctttttttagcggtatattatcatataggctagaaaggaaatacagagaacaaactgggagatccagtctccaactttaatcatctcttctccaaagccaagataatccaagccttctgcccacataagcattgcatcccttcctgccttgcctcttcccatgaccttgtttttcttttgatgttcattttgagggtggagagtagaaaaagcattctctttttgctgctctcagagtcagtggtctttctggacctttaagttctcaggcaaggaaaaccacatagtctacctgagctttcagggactgaaggaaaaaaaaaagtattgctttactcaaattcaggaccacaaataaccactaccaacccattcagttgagtttaataatattattttattgtctgtaattgctcggtattcaagttggcagtataaaaggcctgcagagcaagcttaaaacatggttcaagatcttagatttcttacatctcaggtgaaagacagaccatagactcccaaagcaggttacaatttagatagcaatgtaatgagtcgtacagacaatttgttgtctataggatcttggaaaaaaaacagattcatgaaaagtgagtcaggagagcttcatagaggggaaagaattgggccgatgttcttttaattacctgctgccaggattctcaattagccatctgtttcttatcttacagaaatatcttttgaagatttccatattatctgattccaagttcctttcctgcctctttgtccccattagagatgtcactcatgaggacagtctgacagcagagacttccttttgaccagcaatgggagaaatatgtggaaatagcctgaagcctgagtatagaaggctttgaatgccagtccaaggagttcaaactacaggtcaaagagagccattgacaattttaggcagggcaatgaaatcttgaaaaccatgatttccagtggcattggcagcagtactcagtgtggtttagcatggaagaaactatataggagcctgctacaataattcagagggataatagaaacttggataatgacaatgggaactaaaagaattagatttaccagaaggcagaggaaagacattatagacaggactgagtggcctgacatgaggtgggaggaggtcattcaacttagtcattcagcagttcacttagtcattcagcagatatttacagtgtgcctcccatgttccaggcactgtgctaggcactggaatatagcagataacaaaaagttcttgccttcatggagcttatattctaatagttgaaacagataatacataaaaaagtaaatatataatatatcagatgatgataaaatgaaacagggcaaagaggatggggtacaagggatattgctctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatattgctcttttatatagggtggtcagagacggcttcactgataaattggcattggaactgattcttggaggaaatgagggattttgctgtttagctctttgaggaaggtatttcaggcagagataatagtgcacatctaaggccatgagatgggaatgcgcttatctggtttgagaaacagtaaggagaccttgtacagagtaggcaagaggaagagtggtgggagatgtggtctggggcagcgagcaggtttcttcaggaagggccttggaggctactggaggactggagaggcatgatacagtctgacttctgtttaaatgggattattccagcttctgtgtgaagagagtgctttaggaggagtagggtggaagcagcaagggaagaccaattaagggagcttctataaataattagggcaggaaatcatagtggattgaaacagggtggagctgtggagatggtgagaagtggtcaaattctgggatatattttgaagatggagccaataggatttgctgcttgattgatatggtgtatgaaaaaaatagcagtcgaagatgaccccaagcattctggcctgaacaattcgaagttggaattgccatttattgagggaagtgtgtggaagagccactgattctagtcaagccctgtaattcatgaagaatctgagagccaatgagaagtaacttgccttagtttacccagttaggtagtagttgagatgtgactgaaactaccaggtcttctaaattctactcactgctctgtccagtacataccatatttctgacttcagctttagacatggtaaagggaaggtttagtgagggcaagagctagaagaagacttgaaaattaaccacacaaaagaccagttgaggtcatgaaagggtattcagagtaaagggtagttgaggcctagaaagaagactttgaagagctagcaaagaagagagaagaacaaattaaaatgggcaaaaggaaaatgagagtaatatggctcaaaggacttaagagagaagaagactcaatgatgagttctacgaaggggtcaggaagaatgggaactgaacaaatgtcattagatttgggttttagaatcttgggaaactgtggtgcctacaacttaacctcctttaaaattttaagcacttttcttgccgtttcagctaataaggagaaggaatataacagggtaagcctgagacagagaattaaaaacaaatttacttccaactcctgcattaccttcttgtgaatcctacacaagaatttgactttcccagactcccatatgcccatctataaactgaacaagaagcatacttcttgcccactttgcctcctggagatcctgtgaggataacaatgacaaaggataggaaactgctttggaagagaaatgctacataaatcaagatatccttttctagctgactttaagtttttaatttaagaaaaattcttgaaagagtcacaaaaaactttagagatacactaaatgcaggacgtgttgactgataaaatagatattcttcttggaaacaatggaaaatacttcagtatcattttgattaaatcttgcttaataactgttcattagactcatatcaaatcctgtcttggctttgttatttaatttaatttaattttgtagtcattgttacccaaccacaaaagaattacccctgtgcttaaggccacacagatttttcaaacattgatatatcagcattggtccttctgatgaaacacaagatgaggttttccctgctgagtgtcaggcagtctgtctcaagctgcaggctgaagccccagtggaatctaattccatccttccagtccccttcatacgaagagtgggaaatagtgggaatggaaattaattgtacctgctggcattattaaagttatcagtgcgtatcccctcttgggccaggaagattaaaaaggctgttgtaatcagagcacatgatttctgacacactggatgggcttcctccccaggttagatgtaaggaagtgatctgagcttgttgcctctggcctgataccacatagctcggggctatgcagtgtctgcctcatcctcccatcagccctggaggaaagccaggatcctgctctctgaatcagagatctcttagttggaaaatcaggccttctcacttaagactagtgtattctggctgcgcattcctcacaagatgtagtcaggttaggttagaccttagagtcacaccttgttcaggttcaacctgagtgaaataaggaattgaggtgctgctccctggtgattcagctcattttagcaagtgtttattaaatgctttccccaagcaccacaccaggcccagacaattctgcctgtacacatcctgtggtatttgttggttggaggaaagaggctcttgtagtttatgaattaaagaaaaaaaattcctgatctgggaatgagaatcttatcctacgtttcacactgactcacagcctaactttgactgtgaatgccgcctaactttgtaacctgtctaggacttagttttctaatctgtaagataatggtttggactaatctctctaagatttatctctgaaattctgtaattaagtgagggaatttctatgaaagtgcttggcaaaccattgggctattatgatagttctaagtggaaacagtatgtttcctcaatacacagtgaattgagttctgactctctggggcagatagatttctgactttctgggccatgtgttgagaatatgaagatggctgatgtggcccctgatattgaatacagtgtctagtgggagaaatagacatgcacataagctatgatgatacagtgtaataatgggttcttgggtggagggaaatatgaggtgaggtttgccttatgatgtcctttgtatcttaggaagaatgggagtgtaggagaggggagcataggggatttctgggagataaaaccatttatgcagaaagcaaggaagtataatagatgaaaagcgttccggaactacaggtggtgtgggtgaggatggctgcacacaggtcccttgtaggggagtggcaagcgatgaggctgaggaggtgggcagggccttgcctgccacatcaaagggcttataccctgaagccagtgaagcagaagcccctgtaatgttattgttttaacttcttattttgagataatttcagacttaaagaaagattgcaaagtagtccagaaattcctctgtacccttaacccaaattccccaaatgttaaaatcccatctttccaatatttgggggcgagatttttaaaaaatctcgtataagcacagtacaatgatcaaaatcaggaaattaacacggaggtaatactataatctctcaatcttactgaaatttcacttgttgccttgctaatgtccaattcaaatttctggttcagggttcagtttaggatcacacatgatgtcgaggtgaactgtcatcttagtatcctctaatctctgacagttcctctgtcttgctttgtctttcatggttttaaagagttctggtcagttattttgtagaatgttcctcaattttggtttgtttggtttcctcatggttggattcagtttaagcaattttggcaagaacaccgtagaagcgatgtcatatttttcttagtgcgttatatcaggaggcacttgccgttgatttgtccccattactgacggtgataattttaattactcggtgaggatgggtgtcccctttacagtgtaataaatgtcttgtgaagatactatgtaaatatcctatttctcctcatcttttgcttactaatttttagcatgcttgttaactgaaacaatcctactagcggattttaccaagagagtgccatggacagatttgccttttagaaagattactctgaaatgtttggatgtgagagagatgtgagaacagggaaaaagttactacagtagttcattcaagagcggggccctgatctaaggcagtgagaggaggagtagagaagacagaagagccatttaggctatgtttggaatcaataagcagggtttacattttgtgctatagatttaaatgctggaaaaattctgaaatggggggaaatatcacattttttatagattaacaggcatctatataacctctgggttgctcttcttttttttttttttttttttgagatggagttttgctcttgttgcccaggctggagtgcagtgcgcgatcttgactcactgtaatccccgcctcccaggttcaagtgattctcttgcctcagcctcccgagtagctgggattatagtatgtgccaccatgcctggctaatttttgtatatttagtagagacaggttttcactatgttggccaggctagtctcgaactcttgacctcaggtgatccacccgcctcggcctcccaaactgctgagattacaggcataagccactgcacccggccctgggttgctcttctaagaatagctgactttattaaacatattgtaggtttcattaaatgatgtttcacaaggtgttgcttctcctggaccaaattcctgttgttcagctgagagctatttctaatctccagtgtggatgtgctcatcatttggttataggatgtgagcaaatgagatggtgttctgcgtagcccagaggctgcttccattagccctttcccgaaacttttgccactttcaggcttagcagtatcctctcttgggttcagaatgcctgctctttgccctaatacaaaacctagagctgtaggccatgttcttatgatttgacagtatcagggaagcatttcttattgacttttccagagaaagagagaaaataagcaagccggcaacaagacagaggggaaaagggaagtggctcagttcttactttaagaaacaacatggaagatatgtttgttgatttgagggtggtgaatttttgcactatagctttgtgagggagctggaaagagcctttcagtttttcatgactgggagtttaatttggtttataacattacttaaagataactttgaaattggtctaagaacttagggttgttcctgaccccaggtcaatggcctacttgacctaggcgagaggagaaagagttaaggatagggagttgagctttttgctccaaaatctatagagggtacacccctcttatattctggagtcttactgggtttctgaaaatgcccttgtgggtcatgaaacaatagtcctttgaatatttttctgccgctgctgatgtgagctgcttaaactggcaggcagatgatggaaggaatggttacatgtcccaggcgggaggtcatgacagttggatctgtggttgacagaagaatttcaacacacattcaaatcagctcctaagatagattgtctgagttccctgggcctgcctcatgccctcctcaaatgcatttgactccttctggcccgtaatactcacacttcaaatgtttggcttggcgtccacaaatcaactcagggccggggtaggggtactgatgagcagtgatgccctctttgggagctaccacagcataggaaatgaacattagaccaggaatcaggtaacctggttggggacccagggctctagatggtttatttttttattttccttattggttaaattccctaccgcagttttgacattctcttctggatactgactgtggtctagagaaacagctaaggaaggcaaatctgaattaaaatctggttcttgggaaagaactgaagttttcagattttgcaaaattatggagagtgcagactaggagaaaaaggacaggcatagttgtgacaaggagctcttttttctagttctgcattctagaaacagtactgatgagtccaaaaatatagagataaaatttgtcttttttcttgctttaaaaaagaaatgcttctaaatgtctacatacttgcctaagaaaatatttctcaactcctccagaatatttagggttaactaaaaattataaaaacataccacagagctagtccactctttatgcctagggtttacccaaaaggtgtgcatgctctggcttggagaccctgaccccatctcaacttgctggtttcaagtctacatatttggctgcaaagccctaatgccaggaggaatgcggaactgatgagtccaccccatctacaagctagaaggacatcttgattaaattagtgtcaaggggggtggagagaaaggcacagtgacacaaagggtgttttgaggagccctgtagcgcctgtggagaatgaatgttctcgttaaatatggccgtgacctgcagctccacacatgccagagacacagctcaattgtccccaggatttggggggtggggacgatcatggggagaggacagcctggcatggaaaggcaggaatgcaggaaggcctgttgttgttttctttttgcgataactacagcaagcaattctttgatcatggtccttgtgtttgtgtttggaagggatcaagaagcgatttcctttcccctgggtgtttgaacctttgctctgctccttgcttctctgggtattaaggggactcctgaaagcccccattgtcttcagcctctttccacccccttccttggggctccccaagaagattgttgcctgaactctgtagggcaagaatgagaagcagtgcccccaagacagtgcctacccttgtcatttacccaccatcctcatctcatttatccttaagtcccaagaccaaagcaaagaacacatgggctgttgaaggcttccacaggactgccctggtcagtgggaaagcagtaatgctttctagctgggtaaccccttggctgagttccatctgcactgtggccagggtgcgtggtgagacatgcttttgccatttgccctttgaactgccaacaatcccaatgtagcaaatggatttaaagctgattgagttttagatttctttcctttaaccagaatattctagcagcttatttttatagttctgcttatatgattctctttttaacagatggaatcacaaccttttctgcagtatatatctgatgaatttaaaaactgatacatcaagaatattcttttgtatatgtctttcttgctgtgaaaatttatggcctttcttccccctatcttcgctctgtaattattaggtgcttactatatgcaaggtattgtataagattaggagaatacagataagacaaaatagcattgaaggagtttatgagttcaattccaacttcaccaattaatagttgttctcatggacaaattttttgacctctctaagctttagcgtctgtaagtactaagtgctttttgtgcagagagatgtagagaggtgaaatttgagctgggtttttagtgaatgaaaatgatttcagtaattaaagatgaaaaagtacggagtttgtgagcatggagggggagctggagtcaaaggatattccatatggaagaacaggcttcaggatgaaggagagcaccggaatgtgtgaggactcttcagagggtggtgagtaaaaatagtttggctaaatcagagtgttaatgaggagagcagcttgaaacaaagccgaaaagagcctcgaatgccaaacttggagtttgaacttcattctgagagcactagggaacgatggaagacctactcatagggaaatgataaaatattgctgctatttccgaaagactgggcctctaattccaggacagggtaataagagcctgagatgtggtagcagtgacaggaggaatgaaaagaaggagacagatgccagacatatcatgaaggagaaatgaacagcgtatggccacttattggaaagagaattcgaagtcagcgattacttctttcaatttttttatgctagtgccacttaggaaaagccagtgtgctgttacagaatttgaggtggctggtgaagctgacattttcacatatgtctcaggaactagatgcccaaatctttctcagaccccagatggccccatatagagcttttatacgtgccaatttttagaatttcttgtagagttcctccatttggtggtcaccagaggatctctgagattagtatctggattcttaatcattcagctaatttcagagatgtcctttatttgaggtagatttaacctcctttttctgtttgatggagtgtggtttttgaaaagtccctaaggaagtaacgtgaaaccatacttgaaacctcaggcttgcttctctcttgttttaccagaatgctttggttaccacgtcctgggaaatgaacaacttaaaacgtaagtgtggcaagccttcactatcaccagtatctgttcattgtatcaaacaaagcatatttccattcttattaggtttccagaattgcactgggcctggtgagggctacaaataaacataagataatctgttttcaaaatttaaacttagagttgtgcttctagaaatggaagcttttctagaagaaaattcagaccaatccttttgcttcatgggagctgctttccttgaagaggcttctgccattttagaaaatattactgagtgtcaaaaagctgagcagagtgtttaatagacttgtagggctagcaggacaaatatgggaatttaaggcccaggggcccaggatgggtagccttggtaaaattccccaggctttgagacaccaaagggatacaattaagaaggaaagataagccagaaatagactaaggcagtttcatagagactgaagcctggattcaaattatcttaacctctaattggattaaggtgatttaggatagccagtggctagaaacaaatttaaatcctctctagaggaagatactgtggaagatactatcatcctagacctaatatatctctcatcatttttcatcatgatgtttggcactcagttataaataattaggcctatgaggaaataagaactgtgaccaaaagctaagagaaacagctagacccacaggagatcctagtaatggtgttaacagatgcaaactttaaattaactatgtttaatatgtttatgaaattaaattataaaaacaaacctggaaataataaaaaaaattaactcaaaatggatcaaaggcataaatgcaagagccaaaactataaaactcttagaagaaaatataggtgtaagtcttcgtgatcttggattaggcaatgatttcttacatatgacaccaaagcacaagcgacaaaagaaaaaataaataaattgaacttcatcaaagtcagaaacctctgtgtttgagaggacactgtcaagaaaatgaaaagacagctatagaatgagaaaaggtattttcaaatcatatatctcatcaaggtctaattttcagaatatataaagaattcttagaactcagcaacaaaaagatgaccagtccagtttaaaaatgggcaaaagacttgaataggcatttctccacagaagttacacaaatggccaacaagcacatttttgacactgttatttattgggctactgcaaatcaaaaccacaatgaaacaccacttcacacccactaggatagctataattttaaaaaggaagaaagaaaaggaaagaagagttttggagagggtatggaggaatcagaaccctcatacattgctggtaagattgtgaaatggtgcagatgctatggaaaactgaaaattcctccaaaacttaagcatagaattaacctgtgacccatcaattccacatctaggtgtatacccaagagaattgaaaacatatgctcacacaagaacttatacacaaatgttcataacagcattattcaaaataaccaggctgggcacggtggctcacgcctgtaatcccagcactttgggaggctgaggtgggcagatcacgaggtccggagatcgagaccatcctggctaacatggtgaaaccctgcctctactaaaaatacaaaaaaattggccaggcgtgatggcaggcacctgtggtcccagctactggggaagctgaggcaggagaatggcgtgaacccaggaggcggagcttgcagtgagcagagatcgcaccactgcactccagcctgggcgacagagcgagactccatctcaaaataaataaataaataaataaataaataaccaaaaagtggaagcaacccaaatgttaatgaagtgatttatggaacaaacttaaagtatggcatacctatacaatttaaacaaaatgtgtcatgtccatacaatagagtagtatttagtcataaaaaagaaggaagtgctgatacatgctacaatatggatataccctgaaaacattgtaagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgagttttcttttggcatgattaaatattcgggacttagtggtggtggttgtacaaccttgcaaatatactaatagccactgaattgtgtaccctgtagtggtgaattgtacagtgtgtgaattatatctcaataatttaaaaaaatcaaacaaattttagtacaaaaaatgcagtaactaaaagagctcaatgtgtagatcaagtagcagattagatggtgctgaataaatagttaatgaactgaaacgtcagaaaacaatgcatactgaagctcagagagataaacagatggaaaatacagaaaagagcataagagacttatgggatagggtaagtaggcctaacatgcttctacttgaagtctcagaagaagagaacaaagagaatgggatagaagcaatatttgaagagataatggctgtgaatttccctaaactataaaagacttcaagccacagactgaagcattatgagccccaaacaggagaaatacaaagaaaatacaaacagctagaggtaaaaaagacgtattatcttcagtggagcaacagcatggttgacagctgacttctgaacaaaagcaatggaaagcagatgacagtggaatgaaagtgtagaaaggaatacccttcaaaaatgaaggtgaactaaagatgttttcagacaagaaaaatatgagaaaatatatcgccagcagacttgcactaaaagaaatactaaatggcattatttaggcagaaggaaaatgatcccaaatagaatcttagaagtgcagtaaagaatgaggagcaacagaaactatatataagaatatagattggccgggcacggtggctcatgcctgtaatcccagcactttgggaggccgagacgggcagatcacgaggtcaggagattgagaccatcctggataacatggtgaaaccccatctctactaaaaatacaaaaaaattagccaggcatagtggcgggcacctggagtcccagctacttgggaggctgaggcaggagaatggcgtgaatccgggaggcagagcttgcagtgagacgagatcatgccactacactccagcctgggcaactgagtgagactccgtctccaaaaaaaagaaaaaagaaaaaaaatatagatctaagtgaataatcactgttaaaaacaacactaataatcatctgtggggttttccttttttagatgtgtgggtgggagggacagagtcttgctctgctgcccagcctggactgcggtggcacaattatagctcactgcagccttgaactcctgggctcaaatgatcctcccacctcagcgtcccaagtataacagctgggacaagaggtgtgtgccaccatgcctggcttattttttattttttgtaaagagagggtctatctgttgcccagcctggtcttgaactcctggcttcaagtgatcttcctgccttggacttccaaagtgctgcggttacaggcatgagccaccacaccaggccaaccctgtggggttttaaatatgtataaaattaatataaatggcaacaatgaaatcaacaatagaatctgtgtctgggtgggggtagggaaatgggtttaaagatattttcagaaagtggtaaaagtagtaatttgtattaggtgttggcaattcaaggatatatgttgtaatttttggtaaccactcaaagaatagtattgtaccaatctaagaaagggacaaattcagttaataaaaaagtaactcaaaagaaggaaagaaaaattctggggagggcaaaactatagagatacagaacaaatcaatggcttccagtggttaagggtagcggagagtttgactctaaaggtgcaggatacaagaggtttttggtgggtgatggaactgttctgtgtcttaattgtggtgatggttagacaactctgtgcatttgccaaagcacatggaactgtatgccaacaagagtgaattttctgaatgttttgtaaatggaagaaaaaaagaaggtaggaaaggagaggaaagaggaaaatagaagaggcaggacaaatagaaagcaattagcaagttggtgggtttaaaccataatataaggtgtaaattgacttatgcaaattaaagacagatttttaaaaagcaaaactagagtgtatgttgcttgtaagagaacagatacactttaaatataaggataaagaaagatttaaagcaaagtgataggaaaagatagctacaataaaatcaggccaggtagattcctttctttctttctctctcctttctttctttctttctttctttctttctttctttctttctttctttctttctttctttctttctttcctttctttctttctttctttctttctttctttctttctttctttctttctttctttcttttctttctctctctctctctttctctctctctctctgcccccccacttctttctttctgtcctttttttttcttttttttttttttttttctgagtcttgctctgtcacccaggctggagggcagtagtgcaatctcagctcactgcaacctctgcctcccgggttcaagcagttctcccgcctcagcctcccagatagctgggattacaggcatgcgccaccatgcccagctaatttttgtatttttagtagagacagcgtttcaccatgtcagccaggctggtctcaaactcctgacctcaagtgatctgcccacctgggcctcaaaaggtgctaggattacaagcctgagccaccgtgcccaggcagtccaggtagatttcaatgcaaaaagtatttttcgttataaagagagacatttccaggctgggcatggtggctcactcctgtaatcacagcactttcggaggccgaggcaggcagatcacttgaggtcaggagttcgagatcatcccggccaaaatagtgaaactctgtctttactaaaatacaaaaaattatccaggcatggtggtgaacacctgtagtcccagctacttgggaggctgaggcaggggaatcacttgaacccaggaggcggaggttgcagtgagccgagatggcgccactgcactccagcctggtgatagagcgagactctgtctcaaaaaagaagagagagagacatttcctagtaaagactaagtttccaggaagaaatatatacttaataacataggcttaaaatatgtaaatcaaatgggacagaattaaaatgggaactagataaatcatcaccccaatgagagatttaacacacctgtctcagtgaatgattaaacaactagaccaaaaaagtcagtaaaaatacagaagagttgaaaaacaacaaacttgacctaaatgacatatatggatactgcgcctgacaactgcgggtagatacacattctttttttttttttttttttttttttgagacggagtttcgctctgtcacccaggctggagtgcagtggtgggatttcggctcactgcaagctccgcctcccgggttcacgccattctcctgcctcagcctcccgaatagctgggactacaggcgcccgccactacgcccggctaactttttttttgtatttttagtagagatggggtttcaccttggtctcgatctcctgacctcgtgatccgcccgcttcggcctcccaaagtgctgggattacaggcgtgagccaccgcgcccggccagatacacattcttttcaagtgtacgtggaacatttacaaagtttaaacctgaaatggggaggaaaaatcgaagagcttaggggagaaattagagctggagattggaaatctccatttccaaagtctaccttctttttctcacaattccatgatttttcagtaggagtggggtactggccaagagggaaggtatcctcccccaagaatattgatttttcttttttcaactgtatgtaggccatgactaatgggaatggctacccatgtgtttactgtggacaaagacaagaggcttcaaaccaccattgtagctgaagaaagctgatacaggctcaaatcttcatcccagtccctaggcaatgcattctaatttctgtcagtaaagggctctactcattctcccaaagttggctttgtgctcctcttaggtccaaccctggcacctgaggtgtcaagaaaatgctgtcttcataactcactggagcctcttcctctcgattctaaaggctactcccagtgttctaaaactacacagatctctcgatgaattggctttgctgctgggttcctctttcttaaaagtatttaatcagcgattttcccagtgccccaggcatttcctgtacgagtgctgctgactgttttacttcctaccaggctgccctcctcctcttggcattcacacttccaactttcagatgagctctattaactcctgttcttccagcctccgcctggctcagccatctgggagccacacaggcattctttccatcccccagctcatagatttccttattgtagaagggcatatgttttcaagtaccttatcattctggctctttcccccgattctctcccagttccaagccattgattgtttttcctccttagttcattttacagctgctgagagatttgtgctctcgtgctgcctgtttgcttttgtgtcttttgtcccttatgtcccagtctactcaaggatacccacagtcacctagataccatttctactctgtgcttttagtgtcctgcttgggaaatggggtgatcactcatcttcagaatgacctcaagaaatgctttggcatgagagatcagggcctgaagacattacgcccccactcaaatcattatccaaaagggtaaaagatggaaatttgccaagacaaagatcacagtggtagtttaagaaatgaaagcttagatttgattgtctgttttgttttaagggatgttgttttgagtttattttcttagtattaggataggtcattcaaagagattggaacaaccatggaagaacattcagattattataggactgtgtttcagactgggagagcagagggccgttagcctcttcctgaccccaccctgaactcccctgaactcccacccttgtcccgagtatgcctgtccctgacaagagactttggtcagggaccaaagtgagctttgttagtgagcattcacagagggtaggagctgagtccacaaagttcacatcatgccaaggaatggatttcctcccagggccactagcattacttgtgggttatcaagtgttactgctcacacattccagagcttctggaaaagccgtaaggaaatggctttcagaaagccatttctgtcctagaggagagaggtcctggatttcactgaaccagaacttgatgggtggttttggtattctgtgacctaggtagtggggagctccttcctttggatgtttcctttatgcccacagtcgaaccatatcctagttgtacagccaagaaggatcttttctgtttaatctatctggaggaatagaaggtaattgtatcctccttattttcattctgccacccctaccttcatcatttcttcctttctgctaagcactttttatcgtctttctttgtttcgttttgggagttttgtttttttgttttctttcctcaggaaagctgaattatttcttacagagtcatttagttcttactgaaactggggaagaaaaagattatgcaacagcaggcataaggaaaaacagagaacgttcttcccttcgggcccacagagcccattggaggaattcagctacaatcctgcctgggaagtagtttccaggaccttcgcaattccacatagcatctttaacatgtttgagagtacgtaaggaggcagcatagtgcggcggaaagaacactcaagtgagtgttgagggggctggattctaatattaatattagccaacatttattgaacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgaaacgcagctatattgtttagttcttgtcattatgtgaaagcatagtatttaaactttgatctcattgattcagcaactgattattttatggccactgtgcacaaagcaatgggctgggtaccacagaggattcagaaaaatgcttaaaaagttaaaacctatctcttccattagctttagatggtttcatattgtagttgctttgagatttttttagactaagtttttcagataattaaacaggaatcaaattcaaaaactattcatattccagaagaggaatcctgaaacaagtattgggccttagactagtcaagtttctgacattttcttttaaaatataacttgtcactaggatagtttatatccattaactcctgagtgaaggagcttctggtgaaattgttttttatggtgcttacaagctcaaggggttctttaaaaatggaatgtgactgctttgggagtcactaatactgaagctggatcattataacctgaaatatccattagtaacttagaaagacaaactcaaagaaaaataatttactgtgtaatagctggattttttgaaatcagatttttttttttttttttttggcaagctagattcaatatctagcttgctgtggaattaggttatggtgtggaaacctcttggctgggacaggaaaaaaaattgatcttaaactaaaaaaactaacttaagatattccatttctagtaatacctttgagattggaagaattgcattctgatgggcccagacgttagattaatgtccatctttctcaacaggttgtaaacttttaaactttctgttttgcattcagaccacaagtgcctgacacttaatagatgttctataaatatttgctgatggactctttattgctcactccctaaaatccagccatttctcccttgccagcattcaataattgaacctgctttgaaacatctgatcagccacttcaagacggcaagttattttagctcctgtctaaataagttagtgggctccagtccttaaaccactattttctttattaattcctcaagtacagacttttgtatgtaaccagtctttttaaacctgtgtataatgactcattaatgagttgtaaaataaatgtagtgagttatgaccaatataaaaaaatagaaaaggccaggcacagtcgctcgagaatataatcccagctactctaagaggctgaggtggagggatctttaggccaggagtttgagaccagcctggggaaacatcacgagactccatatctgaaaacaatttttttaaaaattagccaagcatgcctgttaccagctacttgggaagctgaggcaggaggattgtttgaagccaggagtttgagaccagcctgagcaaactcagtgagatcccatctctacaaaaattaccaaaattaaccagcatgttggtacacatctgtcgtcccagctacatgggaagctgagggaggaggatcacgtgacagttgagcccaagagttcaaggctgcagtgagctatgatcaggccactgcattctagcctgggcaatagagcaagaccttgtatctaaaaagaaagaaagaaaagaaaaaagataaaagaataggaaatatcatagtggacagcacataagtagaggtgaagccagctggacttcctcggtggagtggggtcttggagaacttttctgtctagctagaggattgtaaatgcaccaatcagcactctgtaaaaacgcaccaatcagcgctctgtgtctagctaaaggattgtaaaggcaccaatcagcactctgtaaaaatgcaccaatcagcgctctgtgtctagctaaaggattataaatgcaccaatcagcactcttaagagctgtaacactcaccgcgaaggtccacagcttcattcttgaagtcagtgagaccaagaacccaccagaaggaaccaactccggacacataagtacttttattatagacacatattatgctgtattgcaataaaaaatgtattttttgaacatcctagtctacctatcttcagaaggcaaaagcacctctggtgtccctgttgtggtatctcctagcctacctctctataaaagttttgcaattaagtatatttgtgttttatacatccttgggcttctcatagtttaaggtcctaactggagttcagtctttctcagagccgtctcatggtatcctcactgatgaatgaatgctgaatagaaagagccctgcttgcatatatgcaggtagtatggtggaggggaaatctagaagtcatttctgagctctgacctgctggatcatcaccccctgaacccccagagcctcggcatacagcctcacactgtaccacctattttggtggcccaagttagctgagagagaggaccagacacagtgcccaccatcacctagcactggccctgctaccaaacagtcattccttttagccctctcctccccaccaaaagcatttcaggcaaagtgccagctcctgaaatgtggcctctttgaagtggttagtgaatgcccctgaaaccaccaccttatgtatggtggtgcttctgctgccagagcttaatacagggtcatgttcctttcctctgaaatctgtaacataaattcagttttaaactggattttttttttaacagttggtctctgaacaatctttagggtggggaggggatagtagtggttgttggggagatatgtgcccttgaaaactggattcttttttggaaaactgctgacacaggctaaatggcagagaactaaatggccctactgttcctacctgctgacaggctcagccttgggatggggctgaaatgagctctcgccacatggcagagacatgccttcctctttttattcttctttcttacaaatagggggtacttttgtgcctgtcaaaaaatacagctttgaaatgtagataaccaattaacaacagtcccacccccaacttggaaagcacatgagtgctgatctaaataactagagaatcggtaacaagtaacctccctattgagaacaggtctgaaacctctttcataattggtgttctttgggaaacgctaatagacaaacccatccaagctcaggaaatgtactgatttaaagaggtctaaggaagagtgaccagcccagtggccaggcatcccggatgcctaggatccttatgtttccgtacatatctgctgttacatcctttctgtgagcaaggaggctttggaacattacagtcttgtcttggggagatgagatgacacagtgcatttcagttctgtttccaatgctgttatctgttggaaaaaggaagctttcctacccattttgtcagcatacaactggtaggagctgttgcaatctcattgtcttctgatcagcccctcggcagcagtcagagtggaggccagtgaagcactctgaccaaatggttgtggtgagtttcaaaataagagatcccagcctgagcacaccatcacacttcccatccgatagaaccagcattgttaactgtaccacatctctattctaaatttaggcatctttttttttttccaggcaaagattactatgcaaacatttaagagaaaaactttgtccaaagtaattttttcccccaacttctatttggtttcctgcaatgttgagatgactcattctcttccaagaaattttaaagaaaagagatgcaggctgtatgttagtacacaaagactgctctgtaaattctttttcttccctgtctagaaaccccttgcctttttatagagaacggaaaagctctacagtcttcattgtcatgtactcggcctcatcaggttttgttgttcccaggaataaatgtcccccttgtctttgggtggggcccccttgtggcttaccagctctgtcaaccccactgcagtggccagcacggaagcccttcctggggccacgctttcccccaaaggcacacagttaaggtttctgaaacagagaacgaatggccttttatcatctgtgaaaggagagacactggcaatttcctgcctctggcctagtgtcagaatttctcctgattgctagaggctgtattgcacattttaagtgggctcgctacacatgtagtcccagcccaaccctcagccagagggagcagtaagtcagatcacttcagcagcctgttcaaataaacagggataatagttgagtggtcctcccaactaatcagtacatgaaaggaaacatctgcctgggcttaattgctgttgtttttggttacacttttccctccccttcttcccccatcccccactctggggctaggttatttaagtcatgggtaagcaacagggtagaggaataggagctttctcctttaacctctgccattcaaacataaggaggagttaagaaacgataggctggcagggggagatggcccggaggcaggagggcagggcggtgggaagtgatactcatggtcacttcctgaccctgttgctgactctggggctcagagtgagtcatgttgcctcacttcacctccttgggcctctgttgcttcagtggagctcagctttcctctcaatggaaaggacaggctggtatgtgagatcacagatgaaaggcattccctcttgtggcttcttccagcagttgaggtcattggatgagagaccctggaatgataaatttaagactggcaagatcccctgaacccgtccattttgtagagcatctgggtccccgaggagaacttgctcattatcttctagccaaccagccatacactaaagggagggatgtttgaagctaatatggactctagaagccaggcagaagatcatgtagaatcatagaatggcagaggttggaaaagactttagaaatgttttagctgaagcttttcattttatagaagggaaaacagagggccagagaggttaaccaggttgtccagagttacctctttggtaatgcaggagccaggaatagaaagagaatcttgtgattgctaatttagggctccttccacccctttccccactatcagatgtaaaaattcatgcttactcatgacagaggccacacataggttatattccataatgaataccttaatagaaaaatgggcagagaacaccttaataagaaaatggcagattataaaagaaaaatgaaaatgactgataaacatttttaaaaatgctcaggctcattagaatcaaaggattgcaaattacaataggataccacatcaaattgtcaagacaaaaaaatgtgaaataaacattcatatatgctattggtggtattttaaattggtaccgtttttctcaaaggcattttagtggtataaatggtagtctttgacccagcaatgttatttctaggagaaaataatgaaaggtgtgtgcattagatcatatacaaagtaatgtgatatggcattttttatcacaaaaatttagaagtgaagtaaatgtccaagaatgggagctacatcaatagaacgtattataatgctatagaacaataatacatgtggaaatgtttacaacatatgtttaagtgaataagttacaaaacaggatttataatgcaatcccaattttgtaaaactagaaaagattagaaaaatacataacaacacttagagtggtgatttcttagtggtaggaatttaagagttacttttgttttcttttttgaggttttctagtttccttattataataaacatacattacttttgtaatcagaaaaaaaagtattttttaagtagagatgtatgtaccttgaaaaaaagcaagatcttaaatgattgtgtatctgacatgaaagtccttcctttttttgcctgggagctagcagctatggtgggagggatgggaaacagtattataacttctgttagggtggcattttgatacccgaatttctggtaggaaagatctagaaggagctggcaaaagataaaacaagggctttccctctcaatgacccatgctgccaatcagttttagctctcttaggtttggcatacaacacttagtatagaaggtgtgacaatttccttcctgcttcctcctttctttccttttcttttcttttcttttttttgagacagagtctcactcttgtcacccaggctggagtgcaatggtgcaatctcggctcactgcaacctccaccttctgggttcaagcaattctcctgcctcagcctcctgagtagctgggactacaggcgtgtgccatcaggcccggctaatttttgtatttttagtagagatggggtttcactatgttggccatgctggtctcgaattcctgacctcagctgatccacccaccttggcctctcaaagtgccgggattacaggtgtgagccaccgtgcccagccctcattctttatttctactgctctatgtagttagatgtcagccctgggtggcagcagcaaagaacccaggagccatcactgctcaagattaactagttggagaccccttaacatatattttcagcatctagtaacagctaatctcacaggcagtcaatattgagataccgctgccttgtgagttttgggtagaaataaagcaagtaagaaatatagttccatcctgcttggagttttctatttagttagggactttgaagtccctaaatgtttatatactttttcctatttcatcccattacacatcttactttcctttgaaatcttctggaatgcttgactgcaagtatctgagaaaccgtgttccacctaacaacagttgctaggtaggatgtggctttcaggcctgctctttggggaccaatagaaaaaccaaaggctaccaccctttttccctctacgcaattgcctttgctaggctatagagagggcacatttcattttattaaaactctttgagtaatctgaccataattgggtctgattggagtggttatctgatttgctgggttaaataatgggccttaattgagtctgggttatttgtagagccagtgtggcttttgcctttgttgctccctcctctctcttctgtttcccaattaaccttcattcctctttccttgcagagtaaagaagtcggccagcagctccaagatgatttgatgaaggtcctgaacgagctctactcggtaaatcagatgggttgcttggctctttaacaagcagagggaagcagcatttggcagcttgcagccatagtacatcagcaacagaactgaactgaggttgaggacaagtgcatggtccccactgggggtgaccccacccatctcttttttcacactcgtcttttcaaaacggaatgagtcaaaaaatacttcctcaaaataagttttctcctcagctatgcaagctcaccctggctttatttggggcataattactagagaccagccaaagtctaggtcattggcacaatggaccctgttagcagcaaaccagggaccctgaactaatggcaaggaacgtagcctgcattgcactattaatatgtgcctgtcggaaagcctttattgttctaggtttttcatcagatcttggattgatgtatggctttgagactagaacaaatgctctagagggcagcacagagtcctaaatgtccccagtaagagggaccagtttgagcagagagagctttgcctggcttcctggagttttataaagccaaacctcagtgacgaggcaggctgcgggcttggagaagagaacacaatctgttctgagatgactggcgcttcaggcacatgatgcctgtggctggtgcgtgttaattcatgcgcagagaggtggtggtggtggttgttccccagccatgtttttctaattataatgaaaacaaacacacactcacacacatacacaccaaggaaattcctgttgttatacagggaatacttaagttatacagctaatgcctttcaggggccccttctccagcttggatgtgccagcctactatgtcattctccagggtttctccatcctgtttgaaggtgatactgatttctgatgtttacttgcttatttgctgcattttttcttttcttttcttcctttgtttttttttttaattcacagaacaggcagtggtgacatgcatgacaggcatttgggatcagatgttgctgatccagaagcctaggtgtggccattttgtcatggcaactgttaagcaagtaaatagggtagagtagtcatctgacttatctccagcgatgttcagtttgttttgaatttctactctgtgacacttctgctctgaagccaagcatagatagatggtacctttcgttcaactcccaagttttcatttctctcaaatgaagttaagaggttttaaaaatagaaacacatcgatgtgagccattttcagactggatgggtttcctgaaccttgtctttttaatgctttacttctgctcttttagatcaatttctaagcgccaagaagagctattactcctttctcctagcagagaattccctaagatagaaaatgacacatgtagtcattgtataaattcttttattttcctgtaagcatcttgaccctctactatttgcagctgtttctggggaggagtagtttggataaccaacaaaccttgccacttcttcagtgggactcaaggcagcagaagaagactactgtctaaggatctgttagcttttacccagggtcctatgtctcttcatatgctgtgctttaaaaaaaaaaaaataagtgaaagggcgtaagctgtgtttgagtgaggaagaaaaccttggaacttatttctctggtctgcagagggccgagctgctacctctgactgcagacttaagacagcccaatattcgccaactactttactggccattgtgaggccatggtcaacatagagcataacatcttcccattgatgttcaaactgagaattgcctgagtgtggtatcccctgccataaggtgagctggaatacaccttcataatctgttaaaggccaaaattaaaatgtgatgttttcctctagtaggcaatggaaagagggaaaaaaaagagtagaggcactaggaagtttcagagaagtcaaaacattctggtccaaatggagttttaagcagagggagttttaccccgagaggacatttggcaatgcctgaagacatttttgattgtcacaactggaggagtagaaggtgctactgacatctaatgatctagaggccaggggtgctgctaaaatcctacagtgcacagggcagctcccacaacaaagaattatctgacccacaatgtcaatacagagacattgacaatcttctgacccacaagattgagaaatgctggtctagtgactagagtctcctgaattaagcagcctagattctaccctgtcttgactactagctgtatgagcttgagggataccccaaacctctatgaccttggtgtctgcatacactccatgcactggtatttctatatcctagggggtggagtagttgggtgagttatacttcctgaaatattaggctatagctaaggatcaaataggtttccagagtctgtaggccattagaaagttcagtgagccaggctcatgcctgtaatcccagcactttgggaggctgaggcaggcagatcacgaggtcaggagatcgagaccatcctggctaacacggtgaaaccctgtctctactaaaaatacaaaaaaaattagctgggcatggtggcgggtgcctgtagtcccagctactggggaggctgaggcaggagaatggcgtgaacctgggaggcagagcttgcagtgagccgagatcgtgccactgcactccagcctgggcaacagagcgagactgtctcaaaaaaaaaaaaaagaaaaaggaaaaaaagagaaagttcagagaatagccgggcacagtggctcatgcccgtaatcccagcactttgggaggctgaggtgggcggatcatgaggtcaggagatcgagaccatcctggctaacacggtgaaaacccatctctactaaaaatgtattaaaaactagccaggcatggtggtgggcgcctatagtcccagctactcaggaggctgaggcaggagaatggcatgaacccaggaggcagagctagcagtgagccaagatcgtgccactgcactccagcctgggggacagagcaagactctgtctcaaaaaaaaaaaaaaaaaaaaaaaatagcagttcagagaatagaattatttcttctggagattaagataggtttaggactggtctgaataaggcaccatgggattacggtgactaactgtccctctttgcctagtactgaagagtttcctgggacatgaaattgtcagtgatgaaactggaaaagttctaggttaaaaagggttaattggtcaccttgcatgggagagtggttttatcaggtgggaagctgggactgttacatgctagctttgggaagctgcttgctgtatgcacacctttgaggagtcaagaagagaacaagggagagtttcttagaaggagctttcccattatttgcttgtcaggaaggcagggaagggcctctcatttcaatgacgttgtaggcaatagaagttatttggggtcactggaaaaaggaaaccaaggatataagaaacccacccagttttttcatgtccttcacatctgctcctaatgcccatgaatacctttttttaggggactagttatccaagggttggtaattttagtacctttgaaccttgatgatccaaggagcaggacccaggtgttcccaaataaagatgcctttgggcaccgggcccagaatgccgccatgagtggccagctgcccctctgcaccttcctcttttctgcctgaagggcctttgatttccctgacttggcattctgtgctggggcctgcttcccacagctgctattcagagagcaatcctagcgagcattcttctccacgtgttttccccccataatgagctggcttgtatgtaagccatggcataagtggttttcattttctgactgatgcaccgggaatgcctttgaagtcagaacacactgcttcccaaagaactctgggattctttgcctcagttgtactcagaggtcgtgtctggaaaaacccagcaaacccccacaggaaggagtgtacatggaggcactgaagccagtgtggattggctgagtatgaagagtcaaggaagctctagaattgagaaaaaagaggctttgggacactttggggctgttgttattccagaggccttatgcttctgtactccccctaaatttacatccccttggcttggagcagcggctgtgtgctggcagagctacttcagactggtatttagcacctgttcccttgaaacaatggcacttaatagtctctcaactctgcttgcctatttgactctggcactaggcactagggagacaagaacaaataagagatgtttctgacctcaaggcgtttagttttaatagggagagacagaaaagtaaagcatcaagtgaaaaatgaagtgacaagaactcatttacatgtctgcacagaggacagggatgaagtcaggctccttgaagagatacttgaattgaatctttattgccaagaactcttttcttgttctctacatgttcccttttttgttgcatccaacttttgtttcatgatgcagtatcgttttatttctcatttatctctccagggctattatggatatattgttttcaaacttttcttcttgttgtataatatttcttctaaattgctagttttggtcttggtctttcatattagacatttcctttaaatgcctggtcattcttagctgcctattcacattttaaagtgaggcactaaaagattctatgtcagctgtggccttcacagtagggtgttctaactgggctgtgtccttgtggaagccccaactttagtatttctaggtctcttatcttggatggtcagattgccgagagatcacacttttgatctcccactcatgtctgggagctgagttgtgaagaggcctagaccatctcaaaatttaacatagacttcagctaatcctcctgttgaagttcagtatacccctatcctcagctgaaccttgtatcccctagtccatggaccctctctaacagaataaacctctcatctagtcttccactacaatgggagggggatcttggggcctcactgttctcagacttcctttttttttttttttttttttttttttgagatggagtcttgctctgttgcccaggctggagtgcagtggcgtgatctcggctcactgcaagctccacctcccaggttcatgccattctcctgcctcagcctcccgagtagctgggactacaggcacccgccaccacgcccagttaatttatttttgtatttttagtagaggcggggtttcatcgtgttagccaggatggtctcaatctcctgacctcgtgatccgcccgcctgggcctcccaaagtgctgggattacaggcatgagccgccatgcccggcctgttctcagactttcaatagcttattttgtgtttagctctaccttcatcccactgctacttatttctcttcgggcttctgtgatataaatctggctgcttcctggctcactctagttttggtttaggactcaagtagatgagttactgtttgcctacctgcttttcggcttcagcttccattctttttgtttttctcaatttatacctaaatgataatcattttagaaccttttttttcctattattttagtgtggctgtcagagggagcagagctaaatatgtgacttcagtgtttagtttttcaaagtaaagtggaatgttctttgcagaactgagaatttagacttttcagtttttccccatagtttgcatttgcctatctatatatagatagaagtatgtatatgtatatctttatgtatacatatctatatatacatatatgtgtagctatatgtctaagacatagatatatagatatacatacatttacatatgtatatgtacatagatatatatatctaagtcctatcttggctttctctaagtcctatcttgactataaatatatatttataaatatatatttaacatgtatatctgtatctatatacatttctaagtcctgtcttgactttcctattttttcaattgttttggcatcacttatttaagcttcagcttctaggtacctcagttttctcttgagctggaaggcactaataaagcttctccagtatttacccagaagagagattcagtgtcattcagtcatttgggcaaccactttgtaaaactaccattgtgtatatgacatatttctccactgtgagaagaaaacacaaaagaagtagagcttagcgtgaagaatgtatagtttcttaggcaaagtagcgttttactctcttttaacaagaaagttctttaagttttttaggggaaagtaacattgtaaattgttgatttttgttacttcatttgttgacttggtagcgctattctttgaccccttttttatctcatgtttattcataacgttttctctttatcatgcaccttcatgaaataggaaatcactttaaaaaagaaaaaaagcactcacttttgtaacttctcactaagcttttgaatcccatggtcagattcaggtgaaaaaagagaaaaaaaagaggagcctcctatctacacttcttcagctgagataacagatgcctcttttccacttcttagttaacctggaaagctgggggtctgtttgaattacttagaaaggcttttaaacgccattagttgttaagtattttttcttctgtatagaaaatatgaagagtattatcctggtaaaatttacgggaagtagtgttaggttcagaatgaggtgaaactgatttaaaacattctgcattcaaaatgagacataatttagactctaatgtactttgattttgtcagtgtcccagtattctttattctttcatctgcctctagctgatcgtaggggctagattagtatacccacaaagtctttctaagctagattttctcagcgtcagcaccattgacatttgggccagataattagttgttgtgggggctgtcctgtgcatgggatgttcagcagcatccctgacctctaactactagatgccagtagcaatccccaagttgtgacaatcaaaaatatttccagacactgccacatttcccctgggggccaaaatagccccaggttgagacacttctctaactcaggttcatacatggaaccagtttctcttttcaggaatatcttgaccatatttaacctttcctcccaaccagttcagctccagtcctatccagaggagagtcggtgttgcttaatggctaagaatgtggtctttggagtctgacagacctgggtttgaatcctgattccaccatttactcattgtatgaccttgggtatgatagttaatctctctgagccttatttccttatctttagaaatagaaataataacagtgtctttcacagagttattgtaagaattaaatgaggtaatgtacgtaaagcccatggtacacaatgtttattaagtggtagatattaataataatattgtacctttgcactcctgtgttacacacacacatgcacacacacacacacacacacacacatgcacacacacacccaacttctactctctaattctccatctcaaagaaatcttatggcatcacactttcagcactcgtgaactccctgtgtggaaacagaaagttcccacagagtagagcaggcactaggtggctggaagtagtatgtttagtaggattggaaacaagcttgagttctaggcttcctggcctccctgttaagagaaaggattggactcctagatggttgctttgatggaaaatcatccttcaccttttatactacttccctcctgtggcaattccagttatacttgatatggattttattccttcccagactcttacctgaattgttttgaaggcttacagtcttcatagggttgttgtctagattgtggaattgtcctaaggatgaaatgagaaaatgtgttgtgtggtacttggcataaagccaggaatatactaagtgctcagtaaatgataactggcattgcagttgctgtgagagggtgtttgatctggataaagcagaacagacagatccccagaatgccaggccggtaaaaggagcttttggaagcttttcctcttccctattttatatctgaaaggtaacagaaagcataggctactccataggctgcactgccctcttcggggttcctgaccagcccagaaaggctttgcccttggggcctgagagtggtggtgttgtttcccatctactcagtattatgaggtgactaagtgatagaaatcacctggccaatattaaagagaaatgattacaaatgataatgaatagaaataaataatacatgatggatagacattaagttatttcaataagaggaaatgttggctcagttcacatattgctttcctgtgctttggagtggtctttaatctgtgtttgctgaaccaaacacttctggatttttcccttaggggtgtgaggatattgcttcatgggggagagctccagctgagtctgttagtctgtaaagcagagaaatgacccccttggcttgacctctgggggtgggggtgggcgatgtcttgcaggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaaggtatgtaggctcccacagctgtagatgctgggaagcaacattcggtaaggcatggctgataggaatttcccagtagtcactgggaagagcagacgaggaagctctgggttcttttagtgcctaatgactgaaaatgaggccttgctctgtgccctggcaggaatactaggtattggaagaactgggcacgtgggatccaagtttctagcctctagcagaaaaccaagaaacagcagtcacctttcccaatccattttccaaatagagctcaatatcctattgctttggaggggttgggggtgactgtaaacccaggatttggtttcaggtatcaggtgttcaggggcaagagtagtggtacctccttcagagtggcattgcaagaatgaagaatgatatttgaagatagaatcaaagtggggcacgcatcttaagtagggagcctcattaacctttcctgaattgatctacattgtgcccttgaatctcattaaacagaattagaacccaatttaaggcagatgcgcatagggagtagcaacacaattgtagttcttgaatacactgtacttttatcttttagagaacaagccccccttaaaaaaaaaaaggtaaaagtgaacttctgtttccttttcagcgtcaagccaagtacacggagaataagctgaaggccatcaaagcccggaatgagtacttgctggctttggaggcaaccaatgcatctgtcttcaagtactacatccatgacctatctgaccttattgatgtaagtgcttaaagccaagggcctgagggcacctcttttctggtttcagaatactcgtcagacattccccgatactattgttcaggaatctggtgcattttgagaacaattaggaagatagcagccatgatccatcagggtgcttgccaagcaccaagtgaaacacttcacacttattcaatcctaactggaattctgggaggaaggcattattatctatatttttacagattaacagagagtttagatgacttagtcagagtcagttaacaaatgacagaggcaaaatttgcacctaggcctgatgactcaacccaggctcataaccactacactcgtctatctgccaggaaatactttcttccttttttttttttttttttttttttttttgagatagagtcttgctctgtcccccaggctggagtgcagtggtgcaatcttggctcactgcaacctccatctcccaggttcaagcaattgtcctacctcagcctccccagtaactgggactacaggcatgcatcaccatgcccagctaatttttgtatttttagtagagatggggtttcaccatgttagtgaagctgatctggaactcctcacctcaggtgacctgacctcaggtgatccacctgcctcgacttcccaaagtgctaggattacaggtgtgggccctgcacccgacctaggaaatactttattacatcagcttctcttgcacagaagtgagtggcaagaacttaactaaagagttacaatgccatcccttatatttgtatagcatttaaggtttctcagtgttaactcatttgactctcacatcaccattatgggtaagcattgctgtctccagttgctagataaggaagctcaaggtccagaggactacgagactcacttgtccaaggttatgctgcaaattagggtcctgtcaggaaggtatccagctccccctgacatctggcccattttttaaaatatgtgatgcaaaggggattgaggaaagcggctaataggcacatgtgttttgcaaggggcaagcgcagggataagctttttgttttttgcctgtgagttattcttggccttgtttttcctgctgcttccccttacagttgggtcttacaagccctctcacctacagactccaatctggcccaggtcctgagccacacctaagtgaagctatgtaattacaccctttctcacctctccttccagtcatcaaagtgaggcatctggagccagccaatttagcatcccagtctctggggcttcaagtgtatctcatctcggaggcctgccatttgtttcagggtcttgttggcagcagttgggctttgcaaaactctggcccgaccactcttgctttcctgccttggtttctccacaagcaaacctgccacacctcacaacatcatatgggatttgggtccgagtcttgctgttatatcaccacctgggtcatctaggcttgtcactgaattgttctgaaacccagctttgtttctcacccactcccaagctcctctagctaactgaagaactggactaattccctggtattaaaatctggcctcacgtaagagttgcttggggaacttctctaaaatacagattcctgtctccctttagccgaggatttttgattcagtagatttcagccacttaatgccctaggtgtcattgtctcactgggttagtagagccttgctccctgttctggtacctctttgttctctctgcttattgatgacaatctgaacactgtccttcaatggaggtcaaagccctaaacaagatcctttctcctcctcaggggaagagctcctcattgttgggagagaggcctgttctcagcataaggaagagaatccattctttcttatgcacaatttctgctatttatctcgcatttggtaaaaattcagactgtgctgtctgccacaccactgctattggttagccctcttctctttttttgtactcaaggcaacttccctacctttttcaccgaaatactgatctcaggggaagggaggggttactgctgtatcagccacaacctttgcaatccatagattctccatcaggtataaccaagtgttttaaaatcagtccaagaagtgaggtattttgtaccttattttcatcatttaaaaaaaaaaaaacgtctgctaagagcctaatttcacaggatgtggtgtgacatgccattgaaaaagaggctgccttagtacttggcagggtgtgggtctagatcactgggatcaaaaggctacataggtagtaataaagtttctcatgtttctttttttttttttttgagaaggagtctctctctgtcgcccaggctggagtacggtggtgcgatctcggctcactgcaagctccgcctcccaggttcacgccattctcctgcctcagcctcccgagtagctgggactacaggcacctgccaccacgcccagctaattttttgtatttttttagtagagacaggttttcactgtgttagccaggatggtctcgatctcctgacctcgtgatccgcctgcctcagcctcgtttctttgctgctgttttggttgtgtcttgttttagtttgttggttggttgggtttttgttgtttttcctgggatatggacacattcattattttttttaaagttgtattattctgctctataaatgttcagtaaatatttatttagggagaagccacgtgctcagtattggggtaaaaatggattatagtagttctcaccctagaggtagtcataggctgtaagacaacatttttcaaaccattggtcagatcccttaagaaagccaggaaatcacttttattggtttaacctgtgttttcagatgactagatgagactagaataagaaagaaaatattagagtacatcacattggtaagattatgtgaaacttttatgttagatatgtatgtacacacttgtacatcctatgggggagtgtgtgacaatagaagatgtgtttcttattgtgagttgggagtcaaaaaagtgtttgtgagccattgtactatgaacagaggaagatctcagtctcatctgttaagttctgtgagagcaggaaccaagagttttctttaccttagtagcctccagtgcttaatatatagctgagcacatagtgtgtttactgaaggaagaaaggaatagaaagaggaggaagatgatcatctaagctaagatcggtttttctttttgtacctttcaatatggttttgaagtataatttacatacagtaactaaacttaagtgttacagtttcaagagttttgacaaatttgtacatctttgtaacctatgtcaagatatagaataaatattttgataagagatatctttccattgcctcagaaagtttctcttgtctcttcccagccaatcccccaccccaaggcaaccactgttatgatttctttcaccataaattagttttgcccattgtagaacttcacaaagatgggattatccttttttgtgtctggcatcttttgtcagcatgatgtttttgaatttcatccatgttgtttgcatgtatcggtagtgtctttctttttcttgctgacctatgagataaaaagggccaaaaggatgcagttagagcaggactaagtgaggagcctgggatattggcatcctgatcttaacattattcattacttgctttaagacatgggatgaatcctgttgcagtccattgccatctgtgtcatgtacagccttctgcctccttcttagtggttctgaagccaaatgtgtgcataaggcattgaggataagtgaaaagaagttatttttgttgatgccattacattgaccaaggactagcctccgacttctttttatagtatagtgcaagatttaaacttcagactgtaggaatccacgtgaggcatctgccacactggggaaaccttgacttcaggccaaaaagacgttctgagctcatttgatggcatctaagaacgtaggctcactggaatgtaattttcctcccccatactcttctggctctctcaacccaggagcagatggatgaatgaagaacagggcattgtcctcatgcatagctggagtgttgtaagtgccgtgtacatgtatggaaggtctgtgacaccatgtgcacccaagtcggacatgagggaacttggctgtttcagtaagaaatgtcattaagggcag

SEQ ID NO: 1698 - DNA, 161552 bp, Homo sapiens
gttggttcgctctttttttcctcttcattaagtgaaagcaaactgctgttttcaacatacgtattttctgagagattatacattgctattaccttttggctcagactcgatttttctatgctttcaactttttttttttttctagctaggatttgaacctatatcctttcaacttcttttagaaccattttaatgcctagagcattggactcagaagtctagcttctggccgggcacggtggctcatgcctgtaatcgcagcactttgggaggctgaggcaggtggatcacctgaggtcaggagttcgagaccagcctggtcaacatgatgaaaccccatctctactaaaaatacaaaaattagctgggtgtggtggtgggtgcctgtaatcccagctacttgggaggctgaggcaggagaattgctggaacccgagagacggaggttacagtgagctgagatcgtgctattgcactccagctcgggtgacaacagtgagactccatctcaaaaaaaagaaaaaaaaaagtctagcttctgattctacttcaattattaattggtaggaaaagtaaaaatagtattttctctaaggatactttaaggaaattaacgtttgaggcttattgaaaaatttggcaagaggtctctttttattcttttttctttttaaaaaaaagaaaatagagacaaggccttaccatgttgcccacgctggtctgaaactcctgggctcacgtgatccacccacctcggcttcccagagtgctgggattacaggcatgagccaccatactccgcagcaagcggccttttctaaatagtaaatgtattgttttcttttagtcatattggaagaattttaagtgttaatgtggcagcttccctctgttcatataatgatgggtttacaaattattttggctgatctcagaattatggtattctgaatttattaatcttcgaacctgtaggtagtctcttttcagaaccattgaattaagctattaagtgagataccagaaggtctcccaaacatatctaattttatagacagtttaaagcagacaagtttgtaatgttaggacaatctttattttgtatcttttcgaaataggatgtgagctgcaatgaaattcaaactataccttcccaaattggtaacctggaggccttgagagaccttaatgtaagaagaaatcacctagtacatttgcctgaaggtaagaaactatgaaataagaaaccatgaaataattgttttattattttaaagctctctcagaccaatcaagacaaaaatgtataagggttacatctaggctgggcgctgtggctcctgcctgtaatgccaacactttgggaggccgatgagggaggattgcttgaacccaggaattcgagaccagcctgggcaatatagggagtctgtctctacagaaaattaacaaattagcccagggggctggcgcactcttgtagtcccagctactcaggaagctgaggtgggaggagtccctgagcccaggaggccaaggctgcagtgagctgtggtggggtcactgcactctagcctgagcaccagaaagagaccttttttaaaaaaacggggtggggagagagagagagagtgtgtgtgtgtctgtgtgtgtttgtgtgtgtgtgagagagtatgtgtgtgttacctccagtgtttgaaatctaatggtttatttaatagtgttatctgttccattgtggattttaaaagcctcttcaatgaaaaggtttgataactcttgacctttgattttatttttagatcttgtcaaccgatgtaattaataactcagggtagggtccctggaaatttcagtaagcatgactgtttgggggaaatgtaacatgtttggataaggggatagtgtagtataatgaaaaacatttctgcagttagcactcacttaaaaatggactttgacctgaacttaaccggtcactggagatgttcaaacagaggctaatgaaccatgtggaggtgatgtgtagagtgaatgataaatggggtgagagactgcgctaagagacgggttatttacttaggctgactacaagctctgatatatgtatttgataaaaatgattaaacattaatgaagtctagtttatcaatctttcacaaattaatgaaacagaatgctagaaaggaagatgaaaatgagagctattattttatgagatccagaatatatatttcttcctatatgtttctgctcatcacccagcagtaagagtcatcagctcatggcaagtcttgtctcaactgtgctctcatttactttcccctgcactattctctagattaatttgaatcaaatacagaaatttattggtaaacattccagaaaaacaaggaatcttctcaaggtattttcatgacagtgcttttctgggttctttgacaaaatatgacttacagtgtacaatcaatattttgtttgttttgagacagggtctcactcccattactcaggctagagtgcagtggcacgaacatggctcactgcagcctcgacctctcaggtttaggtgatcctctcacctcagcctcccaggtagcttagactacaggcacttgccaccatgtcacctactttttgtatttttagtagagacggggttttgccctgttgcccaggctggtctcaaactcctggggtcaagagatccacttgcctcagcctgtcagagtgctgggattataggcgtgagccactgcacctggccacaatacatgttgaattaactaatgatgttttcgctttccctgtggaattcaaatatttataccaatttgatacagcataatatttagttctaacatactagtggagctttgacattttggattccaagtaaatgtgtaagaacgtgaccttttcagtccacttttatatacttactgcaaccaaaaccttgcgtgtctttcctctcacttggcttgtccaggaaccttcacactttttatcctcagggccttccttattttctcctggttctgtttgctaccaactcaggaatgtaaatgaaggttagcaaaaccaaaatcatgacctctaggaccttataaccccaaatttctccctagggttacctctgtactcaggactcgcctactgtggttggtcttcaaagacttactcctataataatatttagtgtgaaatcaattaatgagaatattagggttttaatcaaaatgaaaattgagcatttcagatgacaatggaagcttaatagttttatcaactaatttatttctgtatcttattttgattgtagactgctgacaaaatggtttatcacacaaatagtttcaatttttttaacagtttattttataatctcagcacatatagttgaactgagttagcaagtgaagctttattccaacagctacattcgttcgtgtggaagtttgtgttacttaattggtaatttctaacattgcaatttggtacatgtcatatatcttttgttatattgccattttgatttaaaattaatttttaccaaataatatgttacatcattcaaaaaatattaaaaaatattaagaatcttttttttttttttttcttgagacggagtctcactctgtcacgcaggctggagtgcagtggtgcgatctcagcttactgcaagcttcacctcctgggttcatgccattctcctgcctcagcctcccgagtagctggcattacaggcacacaccaccacacccagctaatttttgtatttttacttctttttttttttttgagacggagtctcacactgtcgccctggctggagtacagtggagtgatcttggctcactgcaacctctgcctcccaagtagctgggattacaggtgcccgccaccatgcccagttaatttttttttttttttttgtatttttagtagagacggggtttcattatgttggccaggctggtctcaaactcctgacctcatgatccgcctgcctcagcctcccaaagtgctaggattacaggcgtgagccaccgtgcccggccttttttgtatttttagtagagacggggtttcaccatgttgcccaggatggtcttgatctcctgacctcgtgatccgcctgcctcagcctcccaaaatgctgggattacagtcgtgagccaccgtgcccagccaagaatcttaaatagtgtcgttcccctgcctcaaacttccctgcacaccaatttcaatggccaaaagtatgtaccttcattaaactcctttgactctttttttttttgagatagggtctcactctgttgcccaggctggagtgcatggcgtgaccagagctcaccgtagcctcgaactctgtgggctgaagccatcctcccatctgagccttccaagtagctgggactgcagacatgcaccatcacacccagaaaattttgtattgttttgtagagacaagggtctcaccatgttcccctggctggtctcctggactcaagcaatccacccacctcagcctcccaaagtgctgagattacaggcatgagccacagtgcccagactgctgacatatttctaactgatatgtttttatagctattgctggtttgggcaactttgacacttatgtcagcttcctattgtgatgatagatgaggatttagtttccttacactgtcaccataccatgcctttactgctttcctcccatcttcccagtgtagttttagcacaacttctgattaaattgttactcagtgttcacattactgtaattatgtaaacattgttccctgccaattcaagtgatgtactctgattttatttcctttcttgtacatgtttttttctttttttttttgagacagagtcttgctctgtcgcccaggctggagtgcagtggcatgatcttggctcactgcagcctccgcctctcgggttcaagcaattctcctgcctcagcctcctgagtagctggaattacaggcgcccgccaccatgcccagctaatttttgtatttttagtagagatggggtttcaccatgttggtcaggctggtctcgaacccctgacctcgtgatccacccgccttggcctcccaaagtgctgggattacaggcgtgagccaccacgcccggctttttttttttttttcccctggaggtaatagtttcttatctttttatatgcttatttttatgtgtgtctatggctaattccaccctctttttccagcaggctttctggtcagaccagattctctatcccttttttccctgcacttccacctcactgagccctttttttctcttctgatgtggactggctgttctctagtattgctgcccagctttttttttttttgagacagtctcactctgtcacccaggctggagtacagtggcgcgatctcggctcacggtaacctctgcccccccgtcccgggttcaagtgattctctgcctcagcctcccaagtagctgggattataggagcccgccaccacgcctggctaacttttgtatttttagtagagatggggttttaccatcttggccaggctggtcttgaacttctgacctcgtgattcacccgccttggcctcccaaagtgctgggattacaggcgtgagccactgcacctggcctgctgcccagctttctttcttctgtgttaaatactctgagtcctagactctggatcttcctcagttactccctgttttgctggaggacatctcctagtagcttcccaagaacacgtcatgggagaacatatttttgagacttcactggaaaataaatgtctttattctatgttcccccttgattgtttgattataaatccaggttgaaaactattttctttcaagacttttaagtgttttttcactttccactttcagtgtttaaaattgatggttgaaaatctgatgccattcattcttaatcccagtattttgtgaccagcttttgctctctggaagattttaagatggtccctgtttatctgctgctctgaaattttatgttaatgtgccatagcatgagttgttttaatttaatgtgctggatacttggtgggcccctttccaaaccagagatccatatcttccgttttgggaaattgttttatatctttttttttttttttaaataattttctttcttctggtttctctgtcccctttttgaattattttgaattggatgttattagacctctttgttgatcctctttgatttttttttttttttttttttttttttttttttgagacagagtcttgctctgtctcccaggctggagtgcagtggctcaatctcggctcactgcaagctccgcctcccgggttcacgccattctcctgtctcagcctcccgagtagctgggactacaggcgcccgccaccacgcccagctaattttttgtatttttagtagagacggggtctcaccgtgttagccaggatggtctcgatctcctgacctcgtgatccgcctgcctcggcctcccaaagtactgggattacaggcttgagccaccgcgcccagctgatttttcttatattttttattattcatttctgtgtcattttgtgttaccttatggtaaaatagttccaaccattcttatgaatttttaattgctaccattatattttttcatttctacaaactcattctgtgatttttaaaaaatattccttttatgtttcagtgattaaagaccttctctttctgaaactaaagatagtctagcttttcaaaattttcttctgctttctataaaatacctgtttcttctgagttcctttttttggttagttagttggttttgatgttggagatgtctaaatgtctgtggatcatatactatctttatatggctgattagaagttctcagtatactgggcagaaattgtataatggtaattaaacaacaagctgtgtattttattagaagaaattctgtatcattatataaaggccttttatatgggactgtgaagtttatccagagaaagaagctccatttcttcttcgttattgtgtatattcttaagtacagccattcctgggatgaagtaggatagggtggggtgagaaggtgctgaggtcttaatgttaagtgtgtagactttgacttaactcctccatttttagctggcaactcctcctgacttttgtcatcctattgtgcctgggatcccttagttccgagcatttttgattcaatttcactagaaaataacttgctgattcctgggaacattggagaaggatagtgccccagctgtgttagtgggggctgttgacccaggcatttaactgttctttatgtagagtgttatctaatccttttgttatcctcaccttcttgtggtatcagggcctccagcttctgagactttctgtagttctgagcgggtcaaagctgctttttattagtaatcctgtctataggcaactggatctcatttttaccactttgctaccacttttctcatttttaccactttgctaccagttaatcactaaaagagaatgggagtaaatatctatgttaaaatcacatttaactagaagctttgtaaaaattctctagttgtaaaacatcattaattgttcatttccattttaccttcttgcagagctggcggagttgcctttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaaatgttgcgaatcagtatgcagttagcccattttatttgaaagtatagaaacacagacaataaaaaaatgatcaaacaatctggaagtacacacgttaaatctgggtacatataaaatcatcaaacaatctggaagtacacacatgttaaacctggatacataaaaaattatcaaacaatctggaagtacacacacgttaaatctggatacatataaaaatgatcaaacaatctggaagtatacacacgttaaatctggatacatataaaaatcatcaaaccatctggaagtatacacacgttaaatctggatacatataaaaattatcaaacaatctggaagcacacacttgttaaatctggatacatataaaaatcatcaaacaatctggaagtatacacacgttaaatctggatacatataaaaaatcaccaaacaatctggaagtatacacacgttaattctggatacatataaaaatcatcaaacagtctggaagtatacacacgttaaatctggatacatacaaaaatcatcaaacagtctggaagtacacacacgttaaatctggatacatataaaaatcatcaaacaatctggaagtatacacacgttaattctggatacatataaaaatcatcaaacaatctggaagtatacacacgttaaatctggatacatataaaaattatcaaacaatctggaagtacacacacgttaaatctggatacatataaaaatcatcaaaccatctggaagtatacacacgttaaatctggatacatataaaaattatcaaacaatctggaagcacacacacgttaaatatggatacatataaaaatcatcaaacaatctggaagtatacacacgttaaatctggatacatataaaaatcatcaaacatctggaagtatacacacgttaattctggatacatataaaaatgttaatcatttctttaagagattgttggggaaagtgcttttctttcataagttatggagatttttgtgatgttctgagttttcttattgaacatctattacttatatcaaaaaaataaaaaatttaggccgggcacagtagcttacacctgtagtcccagtactttgggaggccaaggcaggcagattgcttgactccgggagtttaagactagccttggcaacattgtgaaaccctgtctctacaaaaaatacaaaaagttagccaggattggtggtgtgcacctgtggtcccagccacttgggaggctgtggtgggaggattgcctgagctggggacgtggaggttgcagtgagctatgatcttcccactgtactccaacctgggtgacagagtgagaccctgtctcaaaaataattagataaataataatatctcagactatgcctaagctaagctagtgcttaataaaaaactacaaggtcaggcacggtggcttatgcttataatcccagcactttagggggctgaggtgggcggatcacctgaggtcaggagttcaagaccagcctggccaacacggtgaaaccttctgtctactaaagatacaaaagttagctgggcatggtggtgggtgcctgtagacccagttcctcaggaggctgaggcaggagaagcttgaaccctggaggcggaagttgcagtgagcccaggtcacataccactgcactccagcctgggcaacagagcaagactccaactctggctcaaaacaaaactaaactaaactaaataaataaataagaatacagcatattgtcattaaccatagtcactgtgctttacaacagaactcttgaacttattccttctaactataaacatgtattctttgaccaacatctcctcagctcccactccctaaagtaattgattttaaaaattataaatgcatgtgttagagaaggaagaataaacaatgtgtattttctattaaatgaaatgagaatttgttttttttccctctacaagtattgcttacaccttaaaaataataatttactgatttttctgtttctaatttggagattatgattacttgggaattctgatagaagtagctttcaaaaaagtgaccattacagaggcaaataagatttgctgggcaaggtgcggtgactcacgcctgtaatccctaatccctgcactttgggaggccaagatgggggtattgcttgaggccaggagtttgagaccagcctggtcaatatagtgagaccccgtctatatatatttaaaaaatttttaggctgggtgcagtggctcatgcctgtaatcccagcactttgggaggccgagacaggccgatcacaagttcaggagttcgagaccagcctggcctatatggtgaaaccctgtctctactaaaaatataaaaattagctgggcatggtggcaggcacctgtaatcccagctacttggggggctgaggcaggagagagccgagatcacgccactgcattccagcctgggtgacagagtgactccacctcaaaaaaaattttgtttttaataataaaagatttgcttagaagattagaaacaaggggagatgactcatacctttatattgtttgaatttttaacaagatgtggattgcattataataggaaatatatttccattaggtaagattttttttaccacttagtttagaattaattgtagattcaaagaaagttgaaaaaaaagctacttttagggaaatcccttcatctagtttcagagttttaaaaccttttatatttctgtcttttcagcgtcctgtttggttggccttcctttgtaaataggaattatttaattgagattataggtttatgatcattttatgtaaagtggacatttcattaaaataaattcagaattagagctaggtattgagtagacagggaggtatggattttgataaaagtttagggataataaagattaaattgtactgtgtttatagtgtagattttactataagattaaatgccactacagctaactttgtctctgttctggctttctgatgtctcccgtgggtgcagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggtaatctttcctccgggacttagtttccaagatctaatgtgggaactcttaaagcaaactgtatttttagtgttaagattacaggaatcttgcatttgccagattgcctctggtagacaggaatagcatgctgcctgggtttggagtggggttaggagaccgtgattagactgttattaatgtgataacccaagtttttagtcaaagtgaaagagagaaaagtgaagcacttcgtttgacttttctgcctgccg

SEQ ID NO: 1699 - DNA, 156293 bp, Homo sapiens
tgacctttgattttatttttagatcttgtcaaccgatgtaattaataactcagggtagggtccctggaaatttcagtaagcatgactgtttgggggaaatgtaacatgtttggataaggggatagtgtagtataatgaaaaacatttctgcagttagcactcacttaaaaatggactttgacctgaacttaaccggtcactggagatgttcaaacagaggctaatgaaccatgtggaggtgatgtgtagagtgaatgataaatggggtgagagactgcgctaagagacgggttatttacttaggctgactacaagctctgatatatgtatttgataaaaatgattaaacattaatgaagtctagtttatcaatctttcacaaattaatgaaacagaatgctagaaaggaagatgaaaatgagagctattattttatgagatccagaatatatatttcttcctatatgtttctgctcatcacccagcagtaagagtcatcagctcatggcaagtcttgtctcaactgtgctctcatttactttcccctgcactattctctagattaatttgaatcaaatacagaaatttattggtaaacattccagaaaaacaaggaatcttctcaaggtattttcatgacagtgcttttctgggttctttgacaaaatatgacttacagtgtacaatcaatattttgtttgttttgagacagggtctcactcccattactcaggctagagtgcagtggcacgaacatggctcactgcagcctcgacctctcaggtttaggtgatcctctcacctcagcctcccaggtagcttagactacaggcacttgccaccatgtcacctactttttgtatttttagtagagacggggttttgccctgttgcccaggctggtctcaaactcctggggtcaagagatccacttgcctcagcctgtcagagtgctgggattataggcgtgagccactgcacctggccacaatacatgttgaattaactaatgatgttttcgctttccctgtggaattcaaatatttataccaatttgatacagcataatatttagttctaacatactagtggagctttgacattttggattccaagtaaatgtgtaagaacgtgaccttttcagtccacttttatatacttactgcaaccaaaaccttgcgtgtctttcctctcacttggcttgtccaggaaccttcacactttttatcctcagggccttccttattttctcctggttctgtttgctaccaactcaggaatgtaaatgaaggttagcaaaaccaaaatcatgacctctaggaccttataaccccaaatttctccctagggttacctctgtactcaggactcgcctactgtggttggtcttcaaagacttactcctataataatatttagtgtgaaatcaattaatgagaatattagggttttaatcaaaatgaaaattgagcatttcagatgacaatggaagcttaatagttttatcaactaatttatttctgtatcttattttgattgtagactgctgacaaaatggtttatcacacaaatagtttcaatttttttaacagtttattttataatctcagcacatatagttgaactgagttagcaagtgaagctttattccaacagctacattcgttcgtgtggaagtttgtgttacttaattggtaatttctaacattgcaatttggtacatgtcatatatcttttgttatattgccattttgatttaaaattaatttttaccaaataatatgttacatcattcaaaaaatattaaaaaatattaagaatcttttttttttttttttcttgagacggagtctcactctgtcacgcaggctggagtgcagtggtgcgatctcagcttactgcaagcttcacctcctgggttcatgccattctcctgcctcagcctcccgagtagctggcattacaggcacacaccaccacacccagctaatttttgtatttttacttctttttttttttttgagacggagtctcacactgtcgccctggctggagtacagtggagtgatcttggctcactgcaacctctgcctcccaagtagctgggattacaggtgcccgccaccatgcccagttaatttttttttttttttttgtatttttagtagagacggggtttcattatgttggccaggctggtctcaaactcctgacctcatgatccgcctgcctcagcctcccaaagtgctaggattacaggcgtgagccaccgtgcccggccttttttgtatttttagtagagacggggtttcaccatgttgcccaggatggtcttgatctcctgacctcgtgatccgcctgcctcagcctcccaaaatgctgggattacagtcgtgagccaccgtgcccagccaagaatcttaaatagtgtcgttcccctgcctcaaacttccctgcacaccaatttcaatggccaaaagtatgtaccttcattaaactcctttgactctttttttttttgagatagggtctcactctgttgcccaggctggagtgcatggcgtgaccagagctcaccgtagcctcgaactctgtgggctgaagccatcctcccatctgagccttccaagtagctgggactgcagacatgcaccatcacacccagaaaattttgtattgttttgtagagacaagggtctcaccatgttcccctggctggtctcctggactcaagcaatccacccacctcagcctcccaaagtgctgagattacaggcatgagccacagtgcccagactgctgacatatttctaactgatatgtttttatagctattgctggtttgggcaactttgacacttatgtcagcttcctattgtgatgatagatgaggatttagtttccttacactgtcaccataccatgcctttactgctttcctcccatcttcccagtgtagttttagcacaacttctgattaaattgttactcagtgttcacattactgtaattatgtaaacattgttccctgccaattcaagtgatgtactctgattttatttcctttcttgtacatgtttttttctttttttttttgagacagagtcttgctctgtcgcccaggctggagtgcagtggcatgatcttggctcactgcagcctccgcctctcgggttcaagcaattctcctgcctcagcctcctgagtagctggaattacaggcgcccgccaccatgcccagctaatttttgtatttttagtagagatggggtttcaccatgttggtcaggctggtctcgaacccctgacctcgtgatccacccgccttggcctcccaaagtgctgggattacaggcgtgagccaccacgcccggctttttttttttttttcccctggaggtaatagtttcttatctttttatatgcttatttttatgtgtgtctatggctaattccaccctctttttccagcaggctttctggtcagaccagattctctatcccttttttccctgcacttccacctcactgagccctttttttctcttctgatgtggactggctgttctctagtattgctgcccagctttttttttttttgagacagtctcactctgtcacccaggctggagtacagtggcgcgatctcggctcacggtaacctctgcccccccgtcccgggttcaagtgattctctgcctcagcctcccaagtagctgggattataggagcccgccaccacgcctggctaacttttgtatttttagtagagatggggttttaccatcttggccaggctggtcttgaacttctgacctcgtgattcacccgccttggcctcccaaagtgctgggattacaggcgtgagccactgcacctggcctgctgcccagctttctttcttctgtgttaaatactctgagtcctagactctggatcttcctcagttactccctgttttgctggaggacatctcctagtagcttcccaagaacacgtcatgggagaacatatttttgagacttcactggaaaataaatgtctttattctatgttcccccttgattgtttgattataaatccaggttgaaaactattttctttcaagacttttaagtgttttttcactttccactttcagtgtttaaaattgatggttgaaaatctgatgccattcattcttaatcccagtattttgtgaccagcttttgctctctggaagattttaagatggtccctgtttatctgctgctctgaaattttatgttaatgtgccatagcatgagttgttttaatttaatgtgctggatacttggtgggcccctttccaaaccagagatccatatcttccgttttgggaaattgttttatatctttttttttttttttaaataattttctttcttctggtttctctgtcccctttttgaattattttgaattggatgttattagacctctttgttgatcctctttgatttttttttttttttttttttttttttttttttgagacagagtcttgctctgtctcccaggctggagtgcagtggctcaatctcggctcactgcaagctccgcctcccgggttcacgccattctcctgtctcagcctcccgagtagctgggactacaggcgcccgccaccacgcccagctaattttttgtatttttagtagagacggggtctcaccgtgttagccaggatggtctcgatctcctgacctcgtgatccgcctgcctcggcctcccaaagtactgggattacaggcttgagccaccgcgcccagctgatttttcttatattttttattattcatttctgtgtcattttgtgttaccttatggtaaaatagttccaaccattcttatgaatttttaattgctaccattatattttttcatttctacaaactcattctgtgatttttaaaaaatattccttttatgtttcagtgattaaagaccttctctttctgaaactaaagatagtctagcttttcaaaattttcttctgctttctataaaatacctgtttcttctgagttcctttttttggttagttagttggttttgatgttggagatgtctaaatgtctgtggatcatatactatctttatatggctgattagaagttctcagtatactgggcagaaattgtataatggtaattaaacaacaagctgtgtattttattagaagaaattctgtatcattatataaaggccttttatatgggactgtgaagtttatccagagaaagaagctccatttcttcttcgttattgtgtatattcttaagtacagccattcctgggatgaagtaggatagggtggggtgagaaggtgctgaggtcttaatgttaagtgtgtagactttgacttaactcctccatttttagctggcaactcctcctgacttttgtcatcctattgtgcctgggatcccttagttccgagcatttttgattcaatttcactagaaaataacttgctgattcctgggaacattggagaaggatagtgccccagctgtgttagtgggggctgttgacccaggcatttaactgttctttatgtagagtgttatctaatccttttgttatcctcaccttcttgtggtatcagggcctccagcttctgagactttctgtagttctgagcgggtcaaagctgctttttattagtaatcctgtctataggcaactggatctcatttttaccactttgctaccacttttctcatttttaccactttgctaccagttaatcactaaaagagaatgggagtaaatatctatgttaaaatcacatttaactagaagctttgtaaaaattctctagttgtaaaacatcattaattgttcatttccattttaccttcttgcagagctggcggagttgcctttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

SEQ ID NO: 1700 - DNA, 154635 bp, Homo sapiens
acattcgttcgtgtggaagtttgtgttacttaattggtaatttctaacattgcaatttggtacatgtcatatatcttttgttatattgccattttgatttaaaattaatttttaccaaataatatgttacatcattcaaaaaatattaaaaaatattaagaatcttttttttttttttttcttgagacggagtctcactctgtcacgcaggctggagtgcagtggtgcgatctcagcttactgcaagcttcacctcctgggttcatgccattctcctgcctcagcctcccgagtagctggcattacaggcacacaccaccacacccagctaatttttgtatttttacttctttttttttttttgagacggagtctcacactgtcgccctggctggagtacagtggagtgatcttggctcactgcaacctctgcctcccaagtagctgggattacaggtgcccgccaccatgcccagttaatttttttttttttttttgtatttttagtagagacggggtttcattatgttggccaggctggtctcaaactcctgacctcatgatccgcctgcctcagcctcccaaagtgctaggattacaggcgtgagccaccgtgcccggccttttttgtatttttagtagagacggggtttcaccatgttgcccaggatggtcttgatctcctgacctcgtgatccgcctgcctcagcctcccaaaatgctgggattacagtcgtgagccaccgtgcccagccaagaatcttaaatagtgtcgttcccctgcctcaaacttccctgcacaccaatttcaatggccaaaagtatgtaccttcattaaactcctttgactctttttttttttgagatagggtctcactctgttgcccaggctggagtgcatggcgtgaccagagctcaccgtagcctcgaactctgtgggctgaagccatcctcccatctgagccttccaagtagctgggactgcagacatgcaccatcacacccagaaaattttgtattgttttgtagagacaagggtctcaccatgttcccctggctggtctcctggactcaagcaatccacccacctcagcctcccaaagtgctgagattacaggcatgagccacagtgcccagactgctgacatatttctaactgatatgtttttatagctattgctggtttgggcaactttgacacttatgtcagcttcctattgtgatgatagatgaggatttagtttccttacactgtcaccataccatgcctttactgctttcctcccatcttcccagtgtagttttagcacaacttctgattaaattgttactcagtgttcacattactgtaattatgtaaacattgttccctgccaattcaagtgatgtactctgattttatttcctttcttgtacatgtttttttctttttttttttgagacagagtcttgctctgtcgcccaggctggagtgcagtggcatgatcttggctcactgcagcctccgcctctcgggttcaagcaattctcctgcctcagcctcctgagtagctggaattacaggcgcccgccaccatgcccagctaatttttgtatttttagtagagatggggtttcaccatgttggtcaggctggtctcgaacccctgacctcgtgatccacccgccttggcctcccaaagtgctgggattacaggcgtgagccaccacgcccggctttttttttttttttcccctggaggtaatagtttcttatctttttatatgcttatttttatgtgtgtctatggctaattccaccctctttttccagcaggctttctggtcagaccagattctctatcccttttttccctgcacttccacctcactgagccctttttttctcttctgatgtggactggctgttctctagtattgctgcccagctttttttttttttgagacagtctcactctgtcacccaggctggagtacagtggcgcgatctcggctcacggtaacctctgcccccccgtcccgggttcaagtgattctctgcctcagcctcccaagtagctgggattataggagcccgccaccacgcctggctaacttttgtatttttagtagagatggggttttaccatcttggccaggctggtcttgaacttctgacctcgtgattcacccgccttggcctcccaaagtgctgggattacaggcgtgagccactgcacctggcctgctgcccagctttctttcttctgtgttaaatactctgagtcctagactctggatcttcctcagttactccctgttttgctggaggacatctcctagtagcttcccaagaacacgtcatgggagaacatatttttgagacttcactggaaaataaatgtctttattctatgttcccccttgattgtttgattataaatccaggttgaaaactattttctttcaagacttttaagtgttttttcactttccactttcagtgtttaaaattgatggttgaaaatctgatgccattcattcttaatcccagtattttgtgaccagcttttgctctctggaagattttaagatggtccctgtttatctgctgctctgaaattttatgttaatgtgccatagcatgagttgttttaatttaatgtgctggatacttggtgggcccctttccaaaccagagatccatatcttccgttttgggaaattgttttatatctttttttttttttttaaataattttctttcttctggtttctctgtcccctttttgaattattttgaattggatgttattagacctctttgttgatcctctttgatttttttttttttttttttttttttttttttttgagacagagtcttgctctgtctcccaggctggagtgcagtggctcaatctcggctcactgcaagctccgcctcccgggttcacgccattctcctgtctcagcctcccgagtagctgggactacaggcgcccgccaccacgcccagctaattttttgtatttttagtagagacggggtctcaccgtgttagccaggatggtctcgatctcctgacctcgtgatccgcctgcctcggcctcccaaagtactgggattacaggcttgagccaccgcgcccagctgatttttcttatattttttattattcatttctgtgtcattttgtgttaccttatggtaaaatagttccaaccattcttatgaatttttaattgctaccattatattttttcatttctacaaactcattctgtgatttttaaaaaatattccttttatgtttcagtgattaaagaccttctctttctgaaactaaagatagtctagcttttcaaaattttcttctgctttctataaaatacctgtttcttctgagttcctttttttggttagttagttggttttgatgttggagatgtctaaatgtctgtggatcatatactatctttatatggctgattagaagttctcagtatactgggcagaaattgtataatggtaattaaacaacaagctgtgtattttattagaagaaattctgtatcattatataaaggccttttatatgggactgtgaagtttatccagagaaagaagctccatttcttcttcgttattgtgtatattcttaagtacagccattcctgggatgaagtaggatagggtggggtgagaaggtgctgaggtcttaatgttaagtgtgtagactttgacttaactcctccatttttagctggcaactcctcctgacttttgtcatcctattgtgcctgggatcccttagttccgagcatttttgattcaatttcactagaaaataacttgctgattcctgggaacattggagaaggatagtgccccagctgtgttagtgggggctgttgacccaggcatttaactgttctttatgtagagtgttatctaatccttttgttatcctcaccttcttgtggtatcagggcctccagcttctgagactttctgtagttctgagcgggtcaaagctgctttttattagtaatcctgtctataggcaactggatctcatttttaccactttgctaccacttttctcatttttaccactttgctaccagttaatcactaaaagagaatgggagtaaatatctatgttaaaatcacatttaactagaagctttgtaaaaattctctagttgtaaaacatcattaattgttcatttccattttaccttcttgcagagctggcggagttgcctttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

SEQ ID NO: 1701 - DNA, 150385 bp, Homo sapiens
ttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

SEQ ID NO: 1702 - DNA, 149199 bp, Homo sapiens
ttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcggg

SEQ ID NO: 1703 - DNA, 148230 bp, Homo sapiens
aaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

SEQ ID NO: 1704 - DNA, 144704 bp, Homo sapiens
ggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

SEQ ID NO: 1705 - DNA, 7820 bp, Homo sapiens
atgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagccct

SEQ ID NO: 1706 - DNA, 2030 bp, Homo sapiens
tggcctaaagtatcacctatcctagtgtcatctattaattttaaagatgaagccatagcctctcagtgaaaatgacaaagctgtgatttaagagcaagaataggacttggagatcattctgacccagtgatcattcactttatagaaaagggaatagcctgagctcaaactcagatatccacttccctgtccacgtcacccctgtactctgtggctgagttctgggccctaaagtgagtctgactggcaaggggtccactttggccaacacaggagcctggtactccttaaaccaaaacatgtagaaagtctttttcctgacaactctggtggctacctgggactccttgcctctctgtccttcataatttttcttcctcctattcctaagaattaagaattcttatatctagtattaaaattcagctctgcttaacagctcttggctaacagatctttgcagaggaaggagggtcccctactgcaattcagggtgacactctctcaagtcgtgacactctctctagtcatgacactctagaggaaagagaaggactagacactctgtgggccaggatccataacatgatgttccagaatcacttgcttttgatgggctctgtattaatggctggaagaaaacatgactaaatcttaacagtggttacttctgctatgataattattatttctctccttttttaaaaaaataatttttgcactttccaacttttcttgaagtgaagaaataattattattccatatatatgtgcatatgtagtgtgtgtatatgtgtgtgtgtgtatcaataaaagtaaaagatgggacttttaagaataccaatgcataggattatccctactaagagaggcagaaagaatagatgatctcagcttcctgaagcaaatattttaaagtgtttagatatttaatatcactgtttaatgacaataacaacaaagaaaaagattagttttgtggtcttaacacataaggtttaaaaattcacctgcagatacagtttttcctggaatccattacaaagatatgtatataaaaatattagtagctacatgtgttaattctcacaataagtgaaattcatatcctttactcagttttgcagatgtcaaaacagaaacccagagaggtgaaattaacttggctaaggacacattcctaagagtgatgacgttcaaatttattccctggtggatttggacgaagttggcacttaaaccactatactcccctaagtgatgcaggaaagaatagctacaaccagttttaaaaatacttagcacgtatagcaactagagcttctgttgaggaaaagttaataataatattattatatcattactctgtgaagctgggagtgggatgaagacagaactgggaaaattttatccaggtattttgctttctggtagcaaaactcggtgcagaggtggaatctgaagaatcaaataatcctaatatcaaccctaaaataaccctaaccctaacccacaaagtgctatctcagtctctctagctgttaaaattccctgatagacacaggatctcattctacttaccccttttttaatgactaaatgctgaggaggcttcagggaacgtcgcgtgacttgccctttttttttcctgttgcccctgagcccggtgccctcagcagccctccgctgcagcaaatctccctgaagccctcagatgcccatgatgatttgtggaggcaacaggccctcatcacagctggctttaagctggcgcaaagaaccacagcggtggcttcaagcctcggctgccctgtagccccaaacctccctaaagggtgagggcctgaaaccgcatgagagttttctaggaaacaggcagctccccgctgcaggaggtcttgtgaaagacatttgcatgacctgaccactcaggcccccgagttcggtaattcctaatctaaccctgtaggtagctttggaacttgacaaatgcagccaaacgattgatttcgaatgactgaaccctcatt

SEQ ID NO: 1707 - DNA, 22806 bp, Homo sapiens
tactggaccgactgggaaacaaagtccattaaccgagcccacaagaccacgggcaccaacaaaacgctcctcatcagcacgctgcaccggcccatggacctgcatgtcttccatgccctgcgccagccagacggtgagcaggcaaggggtgggagcaggcgaacggtgagccaggcaccggggtccctgggagttcctgctcatcccttctctagcattgaccaagccctcctggccagacactgggagactccaggagggtctagacaggggatggtctggctcccgggagcttcagcccggcctggatccagccctggagtctggcagcagcaagtccctgaggccagtcaagtgggggtctgggtgcccagcccccagaaggaaggcaggccggcccctgggagggaagcacagaggaggtggggagctggccttcaggcctggcctgatcctgggaccttagaatcctctcctatctccagcttcagctccctcctaaaagaggcagggttcagacccacccgcctctgtccaggatagagtgagtgaggcagcctttggtaggccagaaaatgtcaccatatttcacgacgttttctctggcagtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccaggtgaggctgtcccccagaccccatcaccagtgcccgctccccaacccccaaatcctccttggaccccaacacctgctctgtcctaatgtcctcatgcatctggttttcccacactaacacccccacatttcttgcctacctcttgtctccccacagcaatacttttacccccgtcacctcacacagacacctccacaccctaaccttgaccctccttgccatgcttcagtgctgccttccccaccctatcccacgcagccccatacctggcctttccgaactcaccatagcccaacctgccccataacaccctgacccctgcctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggagggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggcttggagagcgtcgtccggctgggctccgcggcgcccccactccaggtgcacgggcccggagcccagagccccacgccctgccccgttcctcctgggcgcacagacgcggcctctcgggggaccagtgcctgagcccctcgaccccctccgcttcgcacctgggccaggggcgtgtccggggcgtgccggtgtgaaagtcaccttcggtgcccccagctgggcgggagggggcgcgcggggcgcggccgggattggagcgccgcggagccccgccccccgcccgcggagtcagacccaactttctcccccgcccgcgccccgcccccagcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggagg

SEQ ID NO: 1708 - DNA, 21726 bp, Homo sapiens
ctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggagggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggcttggagagcgtcgtccggctgggctccgcggcgcccccactccaggtgcacgggcccggagcccagagccccacgccctgccccgttcctcctgggcgcacagacgcggcctctcgggggaccagtgcctgagcccctcgaccccctccgcttcgcacctgggccaggggcgtgtccggggcgtgccggtgtgaaagtcaccttcggtgcccccagctgggcgggagggggcgcgcggggcgcggccgggattggagcgccgcggagccccgccccccgcccgcggagtcagacccaactttctcccccgcccgcgccccgcccccagcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggagg

SEQ ID NO: 1709 - DNA, 29826 bp, Homo sapiens
aaaatttataggaagaaccaaaagaataaaaacacaaccatttttataccccatgttcatcgaggagcagcctagcgacgtcgatgtgcccacactggattgcgtccatcaaggcggtgacgccacagttgtctctgtagtctggttcatattggcacctagagccaaaaccccaagtaagagctgagaaaattcaatacctcaaacccaggggacagttgacacctgatcacctgcaggtgaactgcgtgtgtgcaaatgacctgtgagcatggagctctctctattctcccccatctcagtgtccgaactgagcactaagccttcaggagcgtgatggtcttccctagcagacctgctgctcctctaaccttctccatcccatttgacagcacttggtctcttcagcttcctgcaccagagacctggaagccaccccttgccactgcctttcctgcatccttcataatcaattgattacccccatccttcaattccacagccaaaatatttaagacatctgtgtctgagctgggcacagtggctcacgactgtaatcccagcactttgggaggccgaggtgggtggatcacctgaggtcaggagttcaagaccagcctggccaatgtggtgaaaccccgtctctaccaaaaatataaaaaattagccaggtatggtggcatgcacctgcaatcccagctacttaggaggttgaggcaggagaatcgcttgaacctgggaggtggaggttgcagtgagctgagattgcaccattgcagtccagcctgggtgacaaaagcaaaactccatctcaaaaactaaaaaaaaaaaaaaaaaaaggaaaatcctcaatgtggctgatagcattcattctcccaccccttcactgttcaggctcagcatattctaggcgtcttttgttttcttaaatgtaccacagttgttcctggtttggagcatccgtgggtgctgttattgctgtctggaatggtcccttgcctcccgctttcagctaatttctttttctccttcaggtcacagcttaaacactggcgctgagattctttactcttaagccaaattgggtcttcccattatttgttctgtagggatcctgcaagtccttgtaatgcacaacagactttcgggactccttcatggtctgtctttcctgccagtctgttgagttccaggagggtagaaactacatgtgtcttctttctgttgtggcccttgcacctggtacagggctttatttattttttatttatttttttttgagacagagtcttgctctgttgccaaggctggactgcagtggcgcgatctcggctcactgcaagctccgcctcttgggttcacgccattctcctgcctcagcttcctgagtagctgggactacaggcgcccgccaccacgcccggctaattttttttgaatttttagtagagacagggtttcgctgtgttagccaggatggtctcgatcttctgaccttgtgatccgcccgcctcggcctcgcaaagtgctgggattacaggcgtgagccaccgagcactaaatgaatgtataaatgctcgttgaaaaaaatagagaaatggatgattttgccgctgaaaacattttccccagatatttgttatttttgtttcatattctttatctgctatgtcttttgttcatttttcttttgaaagcctaatttttttcttaaaaatgtgtctgagctctttatgtagcactgatatcaactctttgtcatagttagcaaatattttccctgacttgctgtattgttcttacctcttaagaagcaccttgactgcctccaaatggccatgcattgctgggaggagaaagaaagctgagaattagagctttttagtgcacacacaaaatgcttcctgcctcctggctttgctctctgccccgttctattagtgatagcttacaagaaggagtcattaaattgggtacactgttaccgccctacacgaataaatatttaactggataaagcggtaaacaataatgttttcactttatatgtacacagccaacacttgattatcttatcttcacgtgcactttcatgggaaactttcaatcctaaagttacacttctgtgctgtggatccccaagactagtccatttttgcccaggaaatgcaaaatattgtaacagtaatccatggcaaaatagcctggatttaattcccctactaaaagtaactatactcaaaggttatgactatttgtcttccactattttgggtgaatgatggagtgctgattgtttctccaggggagaaactggtcaaataattcatgagctaaaaaaaagttttctacttacttaagaagttttagaaatgattccttggtccctaattgccaactgtggctcatgcctgtaatcccagcactttgggaggccaaggtgggtggatcacttcaggtcaggagttcaagaccagcctggccaacaaggggaaaccccatctctactaaaaatatgaaaattagctgggcatggtggcatgcgccagtaatcccagcttctcgggagactgaggcacgtgaattgcttgaacctgcgaggcagaggttgcagtgagccgagatcgtgccactgtattccagcctgggtgacagagcaagactctgtctcaaaaaaaaacaaaagacaaaaagcaacactataaaacatcacaagtgatgatttttagagaaactaaaagccctctatcctaatcaatgtactacctagaaagctacaagttatattctgaatttcttaatctagactcttgagctccttaatatctaacttctgaaattacagtaattttactttttactaattgttttctttttactttcttcaaacaaatgagcaaattgaaactttttactaaaataatctacaaatagataattcagagttaagagtcactactccaaataataaaaactgtaacccaaatttacattagatgttattgggccaaggtatttaattatgagtatctatatttatttaaaagtatagcactatggtaggtgttactaaggctatgaggatatatatttccctcctgcctttaagagtaagaatgtaaacatgataaagaaaatagcactaaccagttattttgtgctatgtgccaagcattgtctaaaggatttacatacatcatgctctttaaactctacaacaaccctgagacataccatcactgacattattatttggttgatgaggaaacttgctcaagagagagactaatttccttacccaaggtcaaagactatgtgctacagaaccagctcatgggcaaataatctagggaggataacacagatacacacgaaaaataaattaataccacagcatgctagccaagttatgttaactttagaaattgattatatgccaaaaggcccctagatgctttttttttttttttgagatggagttttgctcttgttgcccaggctgtagtgtaatgtagtgcaatcttggcttagtacaacctctgcctcctgggttcaagccattctcctgcctcagactctggagctccccagtagctgggattacaagcagccgccaccacgcccggctaattttttgtatttttagtagagacggcgtttcaccatgttggccaggctggtcttgaacgcctgacctcaggtgatccacccgcctccggcctcccaaagtgctgggattacaggcgtgagccactgcacccgcgcccccgcccccaccccctcccccccagatgttcttattctctgccttctgttttccaaaatcctcctttcccctgaaggtgacctgaacaagatgcggttgggcagtgctgggtgaagcagccacatgtgtgtactgctcacctgcagagctgtaggctgtacctgcagtatgcagaggagtccttctaattttgctctctgtcttccaggcacctgggcaaacagtgagcaggtactggaggatcagagggtcgccttctcgactggcaatgtggaaactgttccagccatctttgttcttcaggagtggattggcgccatgttccaccagctcctggatcacccccaggttcttccttgtgcaggccatcatcagaggagtcctaaggccaaccaggagaagctgtcagatggaggcagctgagacattagaagccaggggccaggtcttcaaaacacacacatccttggcacagatggaaaacctagaggattcaggggtctggcaggcaggaaaacagctttgaccggcaacctctgtgccttctgtgaggaccctgggagaaataataaggggaaaatgattgtaacgaacgtgtacctagaggagagggtgcctgggagacaaagcagcttataagctagttcacaggatagcagtgaattggagcagagctaagaaaacccacagacaaccctcaacacataacgaagtctattcccctgccccagtggggaagatgtacttccctatgttcctaaagatgttcacgccctctaacgaacctgacctagtgagtactaaaatcagtgtcaatctaacaaacgaaatgcaattggcttgtgtgatggtggagcagagtatctctgactgtggtggttatgcaaggctgcacgtatgtgatacaactgcactgtgctctacacacacgagcgcgtgtataactcaggaattctggatattgattggagcaatgccacttgaaacaatgcattggtgcagaagtaacttagctaaatgtccccagaacatcgcatccggaggctatctgtatagtgcacacacttcattgtttggtaacattctctttggttatattctacactattccgtgctctagaaagggaggtgactgccccgaccagttaacccacaagggcaggaacgagggactctgcaggtcatctgcgttataagggaaagttgggcaggaggtccctgccgctgagcaggcctggggtgagaactaggagctgagaacagctacggtgtccaaggggacggagaagcacagggaactcgctacgactctgcgagtagaggggaggcggggtgtctttccgctccacacctaccagtcggccttcttcaggcagtcgaccgctgccccccggcccagcaggtagcgcacgcagtctcggtggcccatggaggccgcctcgtgcagaggccgcttgtagtctcggttggtggcctcgatgtccatgccccaggcctcggccagataggccagcacgtcccgatgcccgtggcgcgcggcgcagtgcaggagggtatccccggccggccccgggcagcccccggccgcctgcagctcctccttcagggcgcgcagccggccctcctgcaccagcctgcagaggcgccgcgggtccccgggctgggccatcgccgcgggtcgggccgggctgcgcggggaggcggcgggcgggacaccggcggccgggcagggagaagccgagggcgagtgggactttccgcctcttcacgcaacctgccccgcgcgccccgaacccggcagaaccgcccctcacgcccccggctttgtccccggcagagccgcctcctcaaacccccggcctagtccgcaggcgggctgccccctcacagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacacgtaagggagtggggcgcgccgctacaccgcaaagccccaaagtggagggtccgggagggcgcgcacagcctcgcccggcgccgtgcagggtggctcctgaggcagccaggcccaagcgtgacctgccccgcacgcgtcctcagggccgccccagcctccagcccctgggggccggcgttcctgggctccgcccccgtccccgcccctcgaccgccgctgctccgcggggactcggggagctcgaaggaactctgggaaagtttcccgctccgccccggcccgagcggaagcgcggatggggcgtggcccggtagctgtggccgcgcccccaccgattgcgcatttcgattggcgttagtggccgtccgtcagcacgccccctccggtctcgcgtcccgattggtcgcgggggccgtcagtccggctccggcggcgggcgcttcccggggctgcggcggggcggagctcgcggaggaagtcggcgggcgtctcgggctccaggtcccggccagaggaggagctcgctgccgggggacgctgggctgagcggccggcggcgcgggcccggcggcggcggcagcggggtccgggtccggagcgccacagtgcgtgaggccgcagacgtggcagggagtgtgggaggggctccgccgtgtggaaaacttaacctccggggtcctgcgcggggggtccgggcccggggtggggcagcgggggccccgggggcgcgaggctgggctcgggcaagcgcgggcgtgggggctcggccgtccgggccgtgggcaggtggagggcgcggcgggggtgcgcgggggaggccagggcgctcactgaactcggtcgggagcggcccccgcgctgccccccgaggccaggaaggcgcagcgtgtgggtcctcggggctgaaggggcaagcgcggggacgtggcctcggctgctaggaggccaggctttcccgtctactctgacgttttgaccttgggcaagtcatttttcgctgccctctgcccctgtgtcatcggtagcttctctgcccctcctctgagcatgggaagcctaaggcgatgtgggaggcctggcgctggtggagggcacggcgagagctgggcaggctgtgggtgatggaagagatcagtaggtgttgggttccttacccgatctgattaggtgccagtcacttaacctctccatgttttcgattcctttagggagtagaatgggagtagctcctatttgccaggcctaaaaacgagtgccgtttacattttttattgcagtctgtggtccgaagacaaccctatgaggcatcagtagggttttacaggtggggaagtggaggcctaaccaagtcagtgactttcttacagaattacaggtaataaagtcttctggaaggcaggatggtagcatgtgttgagtgtccgccagcgtctgccgctgtggtaaaatgagcggagataaatgaaaagacttctggaatgggcccatgaagataagtccgttttactcatgagcagattgagtttggttaaggtaacagtgatgtggatagcctctggagacagaactagtccaagtaccagctttgctcaggttattgttctgtcgtgccttgtcactccagcaaaagaaaaaaaggaaggcataaaagttgtttgaaatgcacaaaagtgtagggcgtgccaagcagtgttctgctgccgttgaagttagtgcaaattggaagttgaggcatctggtagcttcatgctttttgcttttacccctgcccctctcccagtttcagatgactatcttctcttgcattatgtctctagtttccctgttttttaaacataattgggacacacgggttcacagtaggttggaatatatatatatattttgagacagagtctcgctctgttgctccgggtggagtgcagtggcacgatctcggctcactgcaacctccccctcccgggttcaagcaattctcctgcctcagcctcccgagtagctgggattacaggcgtgtgccaccatgctcggctaatttttttgtatttttagtagagacggggtttcaccatgttggccaggctggtctttaaactcctggcctcaagtaattcacccagctcggcctcccaaatgctgggattacaggcgtgagccaccgtgcctagccaggttggaatatttgaacccaggataattggttacttcattggtgttgcacattcgattctgcctcttgtgtcttctctatgaaccttctttgctctgtatccccctttggataactaaatgataatgtatgtgaatctgtcccgcagctcctgtgattttctgggcaaaagcttggtctagaggggcgggatctgaacagtaagctaatggatggagctgtttcctgggtcttgctgttttccggttgggctgctcatttctttcgtgcagacttttggaggttgtggtctggcctttacagtcacgtcacatgtagtcgtcattggcaccgacttgctccttggctgcccttccttttcctcctgtttttcatgggtatgctgttgagcatgcccattggtacactgatcatttgacaggtttcgtgatttgtgagtgtgtgtagacaccactattggtattagatttagaattctaattttgggtttgttgacatcatctttttgctgcttatctcattcctctatccctcctaggctgattttatttggaaactgaatttggattccatctttgcctttctggctgtgaaattacctacttttagaaagcatctcaaatcttatatctgtaactgtcattcacatgccttttgaagaccagtctcagatttcagaggacctcctggagcataaacatggtattccacagataacttaaagccagaaattatttttaaaactaggactttcagcctccctctcactccgggggaaaaagtgattaaaacacaaacactgtttctcttttattccttaacatggttaatgacattaacatctctttgaatgttctactagaaatgccagttatccttgttgctctttatcttttatctttctgtcttgtcaaacaaagccatgttcttatgcacctgcagggtctgctactctcaggcctttgccaattctcacataggttgatatggtggctttctgagttgttttcctgacaatctccatgtctctccaccttctatcctctctcccgagtcactgtcctaaagtgtaaatttgattgtgtaatgaccctgctttaaaaattggatgaggccgggcgcggtggctgacgcctgtaatcctaccactttgggaggccgaggcaggtgtattgcctgagctcaggagttctagaccagcctgggcaacacggtgaaatcctatctctactaaaatacaaaaaattagctggctgtggcggtgtgcacctgtagtcccagctactcggaagactgaggcaggagaatcacttgaacctgggaggcggaggttgcaatgagccgagactgtgccattgtaccccagcctggaccacagacagagtgagactctgtctgaaaacaaaaaacaaacaaacaaacaaaattggatgataccttgaagcccctacctgataaagtccaatttctttttttgaagcccaatttctttatcattatgtgtaaggacctttgtagtctgtggctccaaattccttttccagccttatctcctgtcattcctcatcagggaacctcttgttttgatgaagcccagctttcctgccactctagtgcattgttaatgcctctgtatttttgcacacattgtttccttccgccttactgaatcccatgattctttcaagactcaactcttcgtgaagcctttttcaacttgcctaactctatttatgtttctttactatcataacacttcatgcatgcatttatgtagttgttatattactttatctttagtaacttgtgtttgttttggtagctgccttatgggtaggcttattcacttttgtatcactaatgtctaaaatagcatttaacaccaaggataccataagacaaagctctcatggagtttaaaatgaatctgggacatagcagatacgtaaaagtagttgtggaatgaattgactgtagaaaaagcctttcaaatatataaaattatattctagaccataagtagtgatctttctcttgtttttcaaacattcctttctttctttaggaaaaacatagaacggaaagcccagcccatccttgttggctgtcatacacgagtgctgtctccaagggagtcacaggtgtctcagatgtgagaggatcccggggagattgagcttactgcctgggaacttttggatttctggagaagcaggctgtggtagcctggctctgcgtcagtgaatacctgggaaaggagctggagctctattttgcttgctttctgcattcgtttcttttagagctaatggggacacaatattttgaagtttttccatttcgggtctacagcatttagtggtattttccttatagttatgttttccaaatacttctcaatttctttggttctgacatttcacaatgattttaaaaaaatgtaatatggaaattaaacttgaggttttcagaagctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggta

SEQ ID NO: 1710 - DNA, 3559 bp, Homo sapiens
agaaggaacaagacaataccttactagagcaaaatgacttcccattatagaacatggtctggcactttcaagataaatgaagctgtaaagttaagttgtgcaattagtggacagagacaggtaatttgtgggcatggaggaggtttccaaatattcacagcaccaagtgatcaaaagctgtaagtagcatttgtgcacttttcttcatacattttacattaagaaaaaaaccatataggttgatattaagcagctaactgaaaatgaactgtccttaaaaagtaagtaaataaaaaacagcacttttcctgatgaatgaaggactgtgaaaaagctgttatgggcttagcctatgtagttcccagcattattttaaaaagatgaagaaaagaatgttgaagtctttgcattttcaatgcctaccaggtgcacctgccactcctgcatttctgggtttcacttttgtccattgctagctctcatttggtctgcaaatgtctgagtatctttcatgttccaggaactgtttgtgtgagatagatgcaatggtaaataagtcaaggtcgtcaccttttaggacctcatcctaccaacttaataggtgctagcagagactcgttgtgtgtctattataggataagtgagtgaaagtcctccttaggtaggtttcatcatctgcacttggatggaatgaatttatgaatgttcttagagacacttatagatctgagaaataaaaaacacataccaagaacttattgttgggatgaagaagagtaaataggggaattttttgggttcctcttctcctcatcctccttacaactcctcctgctgataagatatttagtcctatgattgacccagactgtcattttttggggcccttctctccatgcctgtggccaagccctgcctgggcttgtattaccagggatgactccacatgcttcttgcctgctattcacagaaggccctcttgtcttccgtgctcactgcgtggatggaacacccaggcaatgggacaccaggggtctgtatgtgctgcctgtgccagtgttctgagaagctccctgagactggtttggtgtaagggctgtcagtctgctccacaaacccagaataaattggattggaaaagtaggaaacctcatttagcttttgtgcctaaactttgtatacccaagcactgtttaccaaaaaagttctggatttggaagtagttaagtattcaaaacatattcaactatttatgaaaatgatgcttattattctatgtttatttctctcagcagggaagcccaaagagtaggggagatgaggagtaggttgtggaatcaacacccttcctcctgcctccaaaccacctgcactgcccaaggaggggccattcttttttgggagcccattatgtacttagctgtggatgagggtgtatgtgtgtcttatattcctgcttacattatggatagaagattgaaggtcacacttctgtgggtgtcctactgcacccaaaagggtattttacataaagcatgaataattgcaccttttcccccaaatgtcatatactttgatataacattttgtagagttaggagtcaggctttcatggggaagagggctgggttatgtccagttaatgggcaggcatgtagattatactttgcttttgataggtgagggactctttcaagtactattctacttcctctgtggttagtttttttctcccattcttctattctttttcatctttggggctgtacatcaggggaggagggtgctgcagtttgctattataatgggaaaaaatgagagagaaagcaaagagagtaggtaactgtactcagctttatttattttatccacacctcaagctcttattaggaaagggtgggttcttcttttctttttttttaggggggcggttttcttatagaataattactggtattctctggttgataagctaagagaaaagagagtcagggaaaagtactttactgtttttctatgttgtgttcattggttgtttttgtctgtctagtaccaaactttccaccaaccacataccctcttcacggttcccctccttccttctccaacagggaaaggcaggcaccagtggattcctctgtagtcaagacttaacataaccaggaattcttcctaaaggaagaagctatcaattagctaattatacttttcccatcccaaatttgttggacttctttgaagacaggatgatttaaatgagtggagaaggcttacctgggtggagggaagcagggagtaccaacgcatagagtgggaggaaggttggaaatatgagtgagagaaggtgttgatagtggaaggttgcagagaagttgtctgagaacttattcagagccagatggaggaattgttctactgattctcaagaagaattgagagttcttgcagcaattgttattatgtggttttgcaacttctctataatctcttataagagtagtttctcttagaagcctagtcagtatacctgaaactttaattccacttaccattataatgagaaaataaattgtcttattagattctgtgcaccaaggggcaagacctgaaaggaggatggaacggtgtgtagcggggatggcagttgatctgcaaaatcaggcatggaaattctgaactgttattggagagggaaaaggaacaagctacagttaactggtaaaactcagtcatattataggttaatcaaggccatagactgtgtgcttggtactatggaagataaagtgatatggaaagcatgatcagtgaccagtgggcttgtaatctaaatgtggagacacccagaccttagaaaataactatcccataggattatttttggcaaaatgtcaaatgaacaggtcatagataaatgatttaagaattcagaggaggtagagctcacttctacctggaagggtaagaataagcttttgttgacggggagaggctggaggtggaccttcaagggtgggtgggacagagatttgtcagcagacatgaatatggggtgctgggttgggcactttacacatcacagtgtggatacaacaccctggaaaaaccctatcactcccattttagagtaaggaagcataggctcagaaagtataaatatatgacccaaacttccttaaccattgacaggacaagttatagctgaatttcagacttaagccctctggctccaaacccatcctattccagtaccagtttgcctttatgaccttctatacacagaaatgctctgagaacaagaaagcaagtattttgcacccaggatggaaaccacatcattttggtaagggtacaggtcatttgggaaaaaatgagtgatgagtttaaacagtggtctaggtttggaaaaatagtctagaactattgaaggaatttcaggcagagaatgaggtcagccaaactatgttttagagagaagagctgcaaaaggaatgattttgtagatatggcaaatgtttatttaacttgtagcattttaaactagattacttttagctta

SEQ ID NO: 1711 - DNA, 3893 bp, Homo sapiens
agtaaccaaatggtttaacaacctcagtgattgtgttgttctgtagtttgatgacttttatcttgctccttctcattgccattgattgtaccaggttatttcctggagcatgttgtatatcaaggtttatgcaactgtacatttaacctttcagtgcctagctttccccttttcctatagaatcacaagaatttgaaggcaacacaatatgttttctatcttatagtctgaagttaatgcatattaatggcatgctgctattactagttaatactgatgccatgaggattagataatcattgtaaaaaatgtttaatagagcattttttacaatacttagtggatgccagtatactaaatcctttatatatgcttaggtcttttatttcccacaaatctgtgaactaggaattatgaacgcattttacaaaacaggactcgttgcataacttgccaagtcacacagctaatgaacaggagagtcagaacttgaactcagggttgcctgcctctaaagtcctccactaattctcattcattctgtaaaaatagaacatggcctctagaatctcgtcatttagaaaagaacagccttttggagattggttagctggtttgagaacatgtagtttgtttatctgtgtctttgactagtaataacgttcagcctcattaaatctagtaagctaaaaggaagcaggaaatggctgtagtatagacgcttgatatttcagcgatgataatgatggataataatgtgatttcacagcttgggttatcagacccaggtgagtggataagtggattcagattcattaaaatcaccgggcctagtttgtggccttcctttcacaaaccccttaggctgcatattaccctttaatagcatatttttcccattatagttgcccttgctattcatttcaaccacattacaagtataaacatgtacaagggagaggacagatgtccttcccttctgtattaactctcttgttgtatgaaataatgttatgtattaaattattgtctcagtttatagagtctgctagactgtgctgttcagtagaactttttgggatgatggaaatgttcaatgtctgtactgttcactaaggtagcaactagttacctgtgttagttgagcgagcacttgagatatggatgatgaaactaaagaacagatgtttaagtttatttaacccatctaaatttaaatgtaaatacccacatggctggtggctaccttattggacagcagagatttagaatagtaaagctgaatggaccttagagtacatgtaaggcaacacattctttttattttagaggaatgtaggactcagagcatgaaaaggagtaaaaccaagcctaggatcctggtctcttgacttctagttcataatttcttccactaaacttaaaattgttaaaaatgttactttgaactttagtatttgaagattatcgtggtaagactttgcttatatttacaaaagcattgtaacagaaaataaattttgaattacaactgtgactttatcatatttattttacattttatgattgctaaataggtcatatattgacgtctttacatatttgttgggagcaaaagagttgaaagtaaagttttcttcccatctatgttatttagccattgattcccctctccaaagggatcagtaatagtttctttgtgtatctttttaaacattcagatatattaagtatttaaaactgtgtattgttctctcatctttttaaacaactggtaggatatgtacactacacattcatatttttgcattaaacttatatgtggagatcttttgatgtgagtacacaaaaagggtactttaaaacagatacataagcttctattgcacgtaccaactgtagtttaatgcatccctatcgatgaatatttacttcctttccaaagttttctcttaaaagtaatgctgtagagaataactttggacacataactttcatgtgtgcaaatacattataagataattcctagaaatgaatgcactaggtcaaatagtatatacacattttaaattttgataaatattataaattgctctccatagagtcacagcattttatattctcactgacaatctgtaatctctatgccttcatcaacctagtgtgttaccaaactgatcaattcataccattctgacaggtggaataaaatctcagtgtagtttaaatgtacatttttaaaaattgtgaatgagctgggcatcttacatatatgtaagggccatttgtattttatttattgtgaaatatgtttgtatgctttgtccatttccatcagtttttaaaattgacttagaggagcttttatatataagacaaaatatgacatatatggtaaacaaaatgcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagc

SEQ ID NO: 1712 - DNA, 1488 bp, Homo sapiens
gcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagc

SEQ ID NO: 1713 - DNA, 1474 bp, Homo sapiens
ttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattt

SEQ ID NO: 1714 - DNA, 5404 bp, Homo sapiens
acttttcactcatttttggcatacacagttgtgtattcagataattgtcagtgcaatgctaaatgtgttatgttaaaaaatgatgaacatattacctctcagttcttgttatagataatttcttgcaaattttaagctagagatagtcaatatttaatcagagaacatcttcccaggattcaaagtataccacatcagctgttgaatgcagttaatttgcattaatgtgttacaaatcaatgttctgtagtattttaggaactgtaaaacatacctttcaagacaaagtccaaactctttagtatgcaatatgtagttaacctattctggaatgtctcttctaactgagagccaccctgtagggaattaccttagtcttttaattcctgtttgtatcaggtgacttagcaaccacctgcatagcaggaagacggcaccaaggaatatattcatccccttacatagtttgaactatgtgaccaagaaattacagtccatttgtatagagtgccaagctctgaaggctggaagacatgtaagttcatgtataagcataagaaggttgtccatagaatgaaaagagaggaggagagagttaagggccatctgggctcccagagaaagtgagctcaggtcccctttgggccctaaggatgaaacaactgccctttgcctggattcacttgactgggttctttgctgtcattggtagacacatagagccctcctgtctgctttagtcttgttctaccttctcagcctcatatagcaatacctcttatattctgcccccacccaccctgaccatctcagtgatttttgaataaatcttgtctttcactcgcctctgcctttgcgtagaggatacctgctgtgcaaaggtgatgtgagaaagtcaggtctaaattcacctccagactctgcctttggtgggctgtgtaatattatgcacatcacttcaatccttagatttctcatgtctagtatggaggaaatagtacttaacatggagacttttcaggaaaattaagtgaggtattatccacacagccctcataatggtgcccaacactgtggttatcaatagattttagtaccatttttgccagaaagttgaggcagattctaatccaacttttaatatccagatctatccattattccctgattcagtccccaaggtcactcattctttcccttcagctccacaaaaaatccacttacaaatattttatacactaaatcacatcataatcattatggatttctccaaaattaaagtaacaactttttctggttctctgaaaatatgaataaaagaggctgataatgctgcatgcccagaggtgaacatggttcaataagagagagagaccttgtggaagtgatgctggaattgaaatccaaggattgagtagtggcaatggaagaagagaatagtattccaggcaaaatacatggatatagattccaggggaattatgtatgaagaaggagcatagtgaaacttaggccctgcaaggccagtgcagcagagataagcctgtttccttgggtaatggtagggactgtagggcacagtgaacagtgtttatgtcattctataaataatactgataggaccacttattgagtacttcttacatgccagaagttctttggtgctttcattacattaacttatgctattgtccacagtattctaaggtggttgctattagatttccaattttacagaaggggaaactgaggcacggggcggtgaagtaactcccagaatgttcacagtcagcgaaatggtggattctgaatacaaatgaacacaatgaggctccaggtttcctgcttattatcaccgcgaagcccagcctcagcgagcaagggaaggagctagagagcgggctcccaggcacatctgcatgtgtgcactggccttgtaacatcagtctggctcttaagagctgatcagaaagaggacagaaggggagctggcacactggttaggtgaaatgagaaagctcaatgagtgatgatggtaattcagactagaatagttagtgttattttgtgaaaggaaatttcaatttaaccagagcaccttgaagtgaaggctttgaattggaaagaaggttttaaattgctatcagaatttgccattttagtgattgaaacattttagggccaaatgtgccatgctgcacctttccagaaggaactatttgagggaaataactgtcagctcctatagtaccagtgtttaaaatgtaagtttagggagaaaggcagttcaccttctctccaggtggggactgactgaggtgttgaacaaccagatttggggatggtattttttgaatttaattaactgctacatgtgaactagtaagatcaaatcacccacaaggtagatatttgagaaactcagtgtaaatgtggaaaagttgatgttatgttccaaagatgtaataaaaaattaaccagtttatgcaaatgtttatgcaaattaaccagtttatgcaaatgtttatgcaaattaaccagtttatgcaaatgaaaagaggaggtaagaaggtataagatgctatgtttgcatcattcactgggaacatttgaactttgcagattaatgtccttggtggaagaagttatgacattatgttatttgttggggaaaaaccctccagtgtaaagacttttatttatttatttattaaaggcaggatctcactctgttgcctaggctggagtgcagcagtttgatcatagcttactgtagcctcaaattccagggctcaagcaatcctgcctcctcagcctcctgagtagctagtacaatacatgccaccatgccctgctaatatttttttcttttttttttggagacagagtctccctatgttgcctaagctggtctcaaactcctggtcttaggcaatcctcgcacctcaggctccctcagcactggattacagaatacttaaaaataacataaatcagtcagatatttaagcctcacaaacttttcctgaagatttactgagctacttcttcagatgaaaaagacattttgtaataaatggtttctgaaaaaccaaaccctcaaaattgtaactgggatggatatgattagtgaaacacattaaacttaaccctacagggataaaccaagagcgctactgatgtttataaggaaatacaagcattacatcttaaactagacaagtttccactgctgagctaccctgagcttagtgaaattaactattttcacaaaatggaaatccattaatggaaatgacatcataaattcagaaaagattcttagattttaatatacttttcctaatttaaggcaaattgagccaccaagaattgaaagagaacatatttggataattgaaaggcagagtttaaacattccggaaataactatctgcactttcaaatgcaaggtcttgcttaggtttggaacaacacaggttttcttgatcacttgtctaaaacagtaactgagagccacacaacacaacctcgttttataaaggttgtctctgatacttagaaaaatctaaatgtttctgtacttttgcaagttactaaagtctttccattaaattatttgacttttttttctcccgcccaaaaagtgattagcgcacaacaaaatgtgtgtgatttgttaatggagtattctttcattgcagatttatatgttcttaaaacagtgcaagccttttgtggaaataatgtattttgaaatcatatattcttatatacatgtctctaaaagttcatcaaataaaacgtaggaatagacatttttacaaacagaaaacagtcatgtggttctgctatccaaacacagtgacatgatcttttagagtttattttcagtcttttacatattgaccctgtttttcctccatatttgtattcttttaggtttgtttacagagttgtaatagagcatttgtgtgaagcagtttatatggtaagtgacagaaattcagctcagagacactaatatactcacaggatgtattggtctatattgttcctctaggaaggtgtgatccagaaactcaagagaagtcatcaaggactcagtctctctacatatttttcttcctttataagtaaatggcctgcaaatcttttctcatttctgccgctctccctgaaggacctggtagagtacttccttttgaaatatctggctgcagttggcctatagctcagtctgggtttctggcttgttctgtgcatttgtttttcgtgcttcaattagccattgtgtcctggtaatggaaggaaacaatcctcagagatcttgtcacactaagtctgtggcacaatttgaaacattcagtaataccagctgttctaagcagaacagaagtcataattagggatgcaatgatttcacactaaactgtagttacagaatatataactacattttaatgctcatcaatttttatcttatactgtatttatcttcaaagaacaaatgaaccaagtgaattggatttcagatacacagagctggatttatctaatattccctttctcatcttctgctgtaaaaaaattatttcttcttatgtaaactacctaagaagtatcttttcctcccagaatactgtagctttgtctgctcaaatccaaattatataaaatggcaaagctgctctggaacacattttggctgtttaatacacagttaaacatacaatttccatgtgacctcatcatcccacatccaggaaattatcctaaagaaataaaattgatgttcatgtataaacctgcttaataattttttagaaaagtaccattgccaagaactggaaacaacccaaatttccttcagtgggagaatggacaaaaactatggtatatgcataaaatggacaataaaaagggaaaaattattgatatgtgcaatctggataaatctgtagaggcatcagtataagtgactgtagctagattaaatactttgtaattccatttatgacattctgaaaatgtaaaagtatagggacagattggagattgccagggattggcagtgacagaagggtgtgttaattacaggggcagcatgaggcatttctttatggtgctgggatcatcagtatctgtttgtgctggtggttgcaagaatcttcatatgggctaaaactcatacaactgtatagcaataatgtgaatattactgactgttaaataagatatctatgagtgaaccttcactaggcaaataaaataaataagtattaacacctgtgactcatatctgttgtcattttccaaagcttgaagcccagcataacatcatgcttggttttccaattcatcatgcttttgatctttgtatgacacatgcagaatttgggaa

SEQ ID NO: 1715 - DNA, 1552 bp, Homo sapiens
acattaacttctactatacctttgtgtttatttatgaaatgcttacttgtttcttagggcttatttgtccaattctaggtcaatatactattatttgtaatgttttaaagtcaagaaagagtgtttctcatctttttctccagcatttttttagttcttagatatctgttctaccatatcacaccaaagtcatttgctgggtttttgtaaaatcaagattttgtttgaaattgtattaaatgcatatattagttgtgaaaataattcatttataaatatatgatatctcctgcatgagcacaggatattctctgtttgtttgtggttcttttatgtaattttcaataaattttatactttaaaacaaattatgaccttcaactattttattaaatgtgtctttctttcttcttttgagagggggacaatgatgataagcaaaaattgcccccatatgtataacttacatgttttattaaattaccttaggattttttaactctttagtaatttctagggtttttcaaagtgtatcatcataatatctgtagagtttacttttatgtttcttatggaaaattgatatttattacttaatttacatatcctattacattagttaaatcattaaagcaattctgagtaattgtgaatgggaagtcctgatttctattttactttttaaaattaattaattaattagttatatatttaatgttgtgttcttggaataaaattaatttggtcatggtgttttattcttgtaatacactactggattcactttgctagtatttcactttcaattttatatccatgtataaaagtagtatgtatatcatgtttttatggtattatgtttattagctttagctattgataggttttattgttgttactttagctaataatatgttttgttgttgctttgttttgttttaggtttcataaaataagttttagaacattgtacgttattcagctgtttaatattattgatgtaaaataggtataatctcttatattaaggtaagtagagcatatctggaaagccatgtgggcattaggacattttctaatggcagattatgtttcccatcttttctatgatcactggactctacaggttctctatattttggtatttaatttgagaacatgattttctgttgaaaatcatcctttctctagatttgtattattttcattaccaaatttgcccatattttttgaaatttttgtaaatatctcctctgtgtacatacttacatctcatttattatatataatgtacatttttacttctctcatttaaaaaaaaaatcctttctactagtttgcctgtttgattttttttttttttgaacagccttcttttagttttatttatatgtatgctatacttttgggctttttgcttcattaatgatagttttttacttctttaattctccatcctgttattttggttgattttgatgtttcctgtgtctcggaggctttgcagtgaaacttgattgttaatgtaattgagattcagaagctatgagat

SEQ ID NO: 1716 - DNA, 24488 bp, Homo sapiens
agtggttttcccagatatacatatctcccgttttacttaattaaaggaacattttcttttattaacaaattattgaagtctaatagtcatgcagagaggtaccccaatcacaaatgtattacttggtaaatcttcaaaaagtaaacattcctatgtaactatcacccagatcaagaaatgagtaccagtacctgagaagtccttattctacctccctctaaacacctcttttctcctcttcaaaggtaatcactgtcataacttcaaaaaccacagactagtttggcttcttatagaaatttattaaaaatgaaattgtatatatgtatatctttgcatgcatatatatatatatatacacacatacttgtatgtatacatatttctgtttttaatatgtgtatatatgcatgtgtgtatatgtacatgtatatatgtgtgtttgtatatacacacacatatatacacacacacatagatatgtattatatataatatagggtctcactatgtggtgcaggctggagtgcagtggccaccgtaatcatagtgcactgtagcctcaaagccctggcctcaaatgatcgccctacctcagcttcctgagtagctaggactacaggcatgtgccaccacacctggctttttgaagttagatattatgtaatcttttgtgcctggcttttgtgtttcaacatattggtagtcagatttatctaagtttgttgcatgcagcagtaattcattaactcatttgctgtagagtattccattgtatgaatacactgcaatgtattcattcattctacagttgagagcatttagattgtttccaaaatactgctactacaaacattttttgcatattttttgtgtggaagtataacatatttctgttgagaatatattttggaagggattgctgtgtcaaagataagtgtatgttcagctttaataaatactgataaaatagttttctaaaatgctgtgccaatttatattcacaccagtagtgcatgacagttccagttgctctacatctttatcaacacttgctattgtcagtctttttatttttagccattctgatttgggtgcaagtgtattgcattgtagttttaatttgcattcccattttggctattgaggtagagcagctttatatttagataattctatttagtgaagtgctggttcaagtcttttgcccaccccctttttttttgctggatcatcttacttttttctgatttatttgtagtagttatttatatgctctggacacaagcccttggtttataacatgtattgcaaatagcttctctcactttgggaattactctttcactttcttaatggtaggtacctttatataaacatttttaagttaatacagtccagtttgtcaatctttttatgtttagtgctttccttttatcctaagaaatattctcttatctcagggtcataagtaaattttcccaatatgttatatatgctttattattttacctcttacatttaggtttaccattcacctgtagttagtttctgtatatagggtgaggtaggagcaagattcatattttttcacgtgggatatatactttactcaacccaatttagtttaaaaatgtatcctttcccctttctctgcagagtcataagtgcccacatactatgtgtttgctctggattccttacactggtccattagtctattagcctattcttgtgcaaatgccacagtctcaatcaatgtagcttcatattgattcagaatatcgggtagtgaaagtcacataactttgctattttacaagatcgacttggcttaacttggtggttttcagaataaatttaatagtataaattttagaatcggctcatcaatttcatacctcaatgcacatacacatacaaaaaccttcctgtgatttttgtttggcattgtaatgaatgcataaatcagtttgggaagaactgacgtatttaagatattgagtcttccaatttatgaacatgttgtatctcttatttatcttctttgatttctttaaataatactttgtactcttccaggtagaggtgctgtacttcctttattaaaattattcttagatacaaaatgtttttattctgttgaaatggcatatttttagatttaattttctaatcatttgctgctaataaataaagctgatttttgtgtgattactttgtatgcagtgatcttactaaattcactctctaaatacattatcaggagattcttttgacagctttatatccatgaataatggcaagattatttcttccttttcaaccaatttatcatataggttggtgcaaaagtaattgcgggttttgccattatttttaattacttttgcaccaactaatatttcatttattttgccttttcatcctgactaggatctctaggttagccgatgtccttgtcttgttaccattctcaagacaaaagctcccaatacttcatctttaagtaagatgtttgctgtaggtttgtaggtgttgtgtgggaggtggtatgtatgtgtgtgtgtgtgtgtgtgtgtgtgtgtgtgtgtgtgtgagtagatacactttatcagacttgggagacttttttctgtttttaatttgctgagtttgctagttttatgatgaatgagaatttaatttcaccaaataatttttctgcatctattaagatgatcatatgcttgctttcttttgtgctcttcatgtgctgaattaaactgattttttcaatgttcaatcaatcatgcatttctggaataaacacaaattgaacgttattttattctttcttgtgtctcggattttgcctactaataatgaaaaattttgcaactacatttataagagagactggtatgtaattttctcttcttgtatgttttacaggttttagcttcataaataatttggaatgtattccctcattttattccctaatagactgtgtgtaaggctgatgttatttcttcattaaatacttataagaattcattggggaagttatctaggctagggaatttatttcaagaggattttaattacagactcaatttccttaaaagtaatttatgtcatttttaagaattaatggttgttttctaggaatttgtacactttatacacatttttaaatatgatataattttgttcccagtatccttttatatatccttatttaaagtctttaggatctgtgattcccctttttttattcctgatattgttaatttgtgccttctatatttttattgattagcattgccaagatcaattatgtttaatatcaattatattagtcatttataaagacatctgaaaaatgttaaaatttgtgaattcctctatgctgtttgttttctctttcattaatttctgctcttctgtgcagtgttttcttactgttgttttctttgcattcaataagttctttatttgctaaattttttgtgtgtgatgaggacagactcttgctctattgcccagactggaatgctgtgacatgatcatcactcactgcaaccttgaactcctgagtccaagcaatcctcccacctcagcctcccaaagtgctaggattacactgtgcctggccaatttgctaactttttgagatggtatttagttaaataatttttagcttttatttttttctaatatatacattcaaggacataccattttctttaatcatggttttagttgtatgtcacaagtttttttatatcatatttcattatcacccagtatgaaatgttatttaccttgtaattctttaacttatgcattatataaaaatgtattgcttaatatccaaacacttaggaatttgattgcttagtttaactcaactgtagtcaaattaaatattttatatgattttaaactgtagaaaagttttgatgcttgctttatgaaccagtctgcggtcagttctattaattgtcacttgtgcacttgaaaatgattgtgagattctatattagtcagcttgggctgccataacaaagtaccatagactgggtggcttaagaaacagaaatttattttctcacagttctggagactcaaagtctcagatcagggtgccagcatggtcaggttttggggagagtgttcttgtttgctcacatagccgagagacagagcgagagtgagacagcaagagagagcgagagtgagagagcgagcaagagagagaggagtgcaaggtctctgttgtctcttcttacaagggcactaataccgttccaagggccccccctcataaggtcatctaaacataatgtctccatcagtccactttttgctgctagaacaaaatatcacagacttggtaatttatgtagacaagaagttaatttggtttatgattctggaagcttggaaatccaagagcaggcaccagtatctggtgaggatcattccatggcagaaaagcaacacctagcaagcaagcctaagttatcttttcatcagaaatccattcctgtgataactatttcactcccaggataacagcattaatccacccctgagggaggagctctcatgagctattcaccttttaatggatccacttcccaatactattacaatggcaattaaatatcaacgtgagttttggtgggaaaattcaaaccctagcccctaattaactcccaaaggcctcatctccaagtaccatcacattgggtgttaggaattcaacatatgaatttgagggcaccttaggttagtccatagaagttgcagtattttaaatatttgtcatcaataagttcaactttatttatcatattgtacaaatattttataatgttattaatttttttctacttgatctgttagttacagagaagtgtatattaaaatcccccactatcattagggattttcctattcttgaatgtgtgtctattatatcatatatgtaaaacatatgcatgttactaggtagatgcatatttagattttaagtgtattgaaacttattgttattaaatagtcttcatttctagtaatgagatttgtcttactattgattttacctgttatcagtatagttgtaccacctttttaaatttatgttttaatggtatatgttttacaaacctcttgccttcaacctttctttatgtaatgaccatgtagtagtctttttaaaaactcagtttgtatgctttaattgagttatttaattactttatttctttatatttattcattaatatatacataactaatatgtttgggtttaattctctactactttattattgattttgtatgtgcttcatctgtaccatattcaattctcactcttttctggccttctgtggaattaattaatattttctcatctcccacattagcatcttaaataaacattcttttaccatttattttgtggttatcacagagactacaacatgctaccttgaattttttaagtctactatatattagtatttttattacttcccaaagaatgaaaggtccttagactccttttcctacttacaaattactgccttttgtgctatttctgtcattaattaattctacaatatatttagtgattttgtaaagttaatattcatgcatatttgccacatatttaacctttctgttgctttctgttgctttatttctcatttccatacttttatattaaattatttttcttatgcaggaataactctttgtaatatttcctttagtgcacatcttccaataaaagttacctcaaattttaatgatctgaaaataactttatttgagatatttttaaagaacattttactggatgaagaatttgaaattaacagttattttcttttgcactttgacattctcttgtcttttgacttccacaatttctgttaaaaagtcattagtcttgttgcaattgaaagtaatgtgttttttcccctctggtaattttttttttggttttgtctttattttcagcagatttattgtgactcatcagatttagtgtggttttctatctatttatcctgtttcaggcatgctgagcttcttgaaaatctgggttagtatctttcatcaattttcaaaaattcttcacattatctcttcactgattgctactcattattcgctcccttttttcctggaatgctaattatatatgtattataacttttttatgtatcatatgtctcacattcttttatgcattttccattatttttcactccacatttctgcctagatattttctactaatctatcttccggcctagtaatctcttcagttgcatttaacctgaattcttaagtttgttgtaggtttttagttctaacatttacatttgagtcttttaaatatattgttagtctttcatgaaattattccttttgctatgtatatattgaacatagtgattagttatttaaaagtctgtgtctaataacttcaatatatggatattcttggattttctttctattgtctgatttttttcatttgtttctcaatcatttggacatatttcctcataatttattattgaatgatggagatactgtatggagcattgtacaaataacttgatgcatggtatactctttcttcatctttccttttcttctgtcaggctaagaaaaaatcatcttaaacctattgattgagttgattgaaaaattttttttattattgcaaaagtgattctatttttggttctctcttactcctaagaagtagccatttgattgtttgcagccaaacaatccaaatggaaagcccttctccttcagtgaatcttgagatccaatttttgtctctgaagcctggaaagattactaaaagttcatctccattttttatcctctcagcttccacttacaaatcagcatatgcctcaataggaacatggagctgaagatcagtctcactcctctgtacttccctttttctctgggatcttatcctcacttattcatgctgctatggatgaattacttcaaaagtatgttttcctttttactcaccattttattatgggaactttcagatataaaaaataggttaaagtgtgttacagtgaacagccttatacccacagatcagattctataatttaaatttcatcctgattgacttattatatgtctctccctctatctgtccctctgtccatctgtcaattaatcttactttttgatgaatttcaaaatacattaaggatatgaggacattcccttttaaatctttcagcctgcatttcattaactagtgttttacattgttttacaaatatttttcattagatataaaatttaaataaacaatttgcatgaatcttaaatgaacatagacagacaagggtatacgctgtacaatccaagcctctatcattccaggaagtcccctagtgcttctttcccattattcctcactcctgccccatccccacagaggcaactgttattataattttttgtacaataggttagttttgcctgttgtaaaacttcataaaatggaatcacataaaatgtataattttttgtaagtcttcttgaactcaacataacatttttgaagttcatccatagtactctgtgtatccatagtttattcctatttcattctaaggaatattctattatacaaatacacgacagcttgtttactcattctcctttgagggatacctgagatatttgtatcctttgccctgtttctgatcttaggggcaatgaattcaacatttcactagtaaatattatgtcagttttatggatgctttttatcagattgcaccttttatcagattgtggaagttccctttgcatcctgctttgctgtgtgtgtgtgtgtgtgtgtgtgtgtgtgtgtgtgtgtttatcatgaataggtactgaatattatcaaatgcttctcctgaatctattgaaaagatttttcacccttatcctatcaatacggtgaactacattgattgattttcaatgttaactgactgcattgctgggataaacccaacttggtccatatatatatatatatatatatatatatatatatatatattctattcatgatattcatgaatattttgtgatacagttcaattgtgtcccctcccaaatctcatcttgaattgtagcttccataattcctatatgtggtgggagggacctagtgggaggtaattgaatcatggaggtgggattttctcatgctgttcccatgatagtgaataagtctcacgagatctgatggttttataaatgggagttcccctgcacatgctctcatgcctgttgccatgtaagacgtgactatgctcctcattcgacttccaccatgattgtgaggcctccccagccatgtggaactgtgagtcaattaaacccctttcctttataaattacccagtcagtctcaggtatgtctttattagcattgtgagaacagacaaatatagaatttcagcatttgtttataaagatgttggtctgcaactttatttttcacttatttttcttaaggagagtaatgtctttgtctctttgccaggttttggtattaggattatactcgccacatataacaacatgggagttgtttcaagactgatgctatttcttccttaaatttttggcagaattcaacagtgaaaacatctttttctactgtttaattaatgggaaagtttttgatgataaattaattttttctaatagataaaggctattcagattttctacttgatcatgcataagtgtaagttgtatttttcaaattatgcttccattccacctaatttgtcaaatttattgcctgaaatttttcatggaagtcccgttttccttttaacctctgtaggatctgaggttttagatcttttattgctaagttttttctccttcatatttgtagaccagtctagctaggagactatcaattttgttgatctatctaaagaacaaattttagttcctattttctatttcattaatttcatctttgttatttctttgctctacttgatttggtttgctctgttcttttctatttataagcattgaaagctaaaacttttcctctaagcactgctttagctggatcacatagatttttcttttctttttttgtggagacagggtctcactacatggcccaggctggtcttgaactctgacctcaagcagtcatcccacctcgacctctcaaagctctaggattacaggcatgagctaccatgcttcacctgaatcccatagatttagctatattgtattttcattttcatacaggtcaggatattttctaatttcctatgtgaattcttctttcacctatgtaatgcctacatgtgttgtttaatttccaattacgttgggatttccagatctcttgttctcattggtaagtaatttaactccattgtagtcagagaatatactctgtgtgatttcattttttcaatgtactggggcttgttttgtggcccagcatatggtctatcttggtaaatatataccaggggtccttgataataaagtgtatgccacatttaattactattctacaaatagtgattaagtcaaggtggtcaatagtgttgtctttaccttaactgatattttgatcatttttttctactaacttcttaaagagagctattaaaatgtcaagctttattgtaaattgtctacttctccttctatatctgtaagtttttgttctctcatgtggtaccaactgtggtctgccctcaagctaaaaaatatttttaaagcaataaaatcatctctatacccctccctgttttgaaaagccaactcccctccagaacctgcctgcatttgttcacttttgggccccagcatatagtttttctttgaaagttttgttttggtctagaagagctcactcagctgtactataagtggaaccttcgcatggtttttaaagatattgtttccaggctgagcatgatgactcacacctgcaatcccagcactttgggaggctgaggggcatattacttgagctcatgagttcaagagcagcctgaaaaatatggaaatacaaaaaaattagctggatgcggtggcatgcacctggggaaccagctactcaggaggctgaagtgggaggatcacttgagcccaggaggttgaggatgcagagagccacgattgcaccactgcactccagcctgggtgacacagggagaccctgtctcaaaaaaatttttttccagctttttaaggcgtttctgttggaagaattgatatattacaaattggcctgtataaccataagtaagaatccctaataaatatatttttaaatgaatttttgtatctccataaataaacttgataaagtaaaacaaattaaatacaactattaaaatgtaaaatgtttatccatgtaccaccaaaaatagttttccatgtcagtggcagaaacattatgctttgggaaagtacatacttgctaaagtgaccagatcactgatatgtgcaatctcatgtttggaaggaatcttgactaccacttatccaaatctgaaacccctacacaacaatgtttcaaagtggtctcatacctaagctcatccagtgacagagaacagctcctcagctgtggaggcaaaggattctatttttggaaattctgtatatcagaaccatcaactttgtcttaacttgaaatctgcacccctgtaaattccatccatcaatcctagctttactccttggaatcttgcagattagtcacactttccatttacttcatgaccctatagatacctggatcttttctactccgatttgttggatgttcctaggctcctgggatccacaatgctaatgctagatattggtgtcggtttgtttatgaaaaagtaattagcaggtagatacaagagttaagaatttatcccaggacttactgatagctttatcacaggaaaattaaaattaaaagttctgggggccaggcgcagtgacttacgcctataatcccagcactttgggaggccaaggcggccagatcacttgaggccaggagtttgagactagcctggctaacgtggcaaaacttcatctctacaaagaaaaaaaagaagaaaaatacaaaaaattagttgggcatggtggtgcacgcctgtaatcccagctactcgggagactaaggcacgagaatatctttaatccaggaggtggagggtgcagtgagccaagatcatgccactgcactccaatgtgggcaacacagtgagatgaatccgtctcaaaaaaaaaaaagttatatcaaagaaacatttcctcagcaaaatagatcctttcattatctttactacaaagcaaagaagataaaaaagcaagaaagatgtggagaaaaaagatttcctcagttgggaaccttaaaaggtcatctataataatattattgaaaaagagatagagttcatctatttaatcctgtttcttcagaaaagaccaaccttatgtcatcagaaataagaaagtagtaattacacttttaaagctgtcttttaatcccacctgtgattaaaattcttttctagctcctactaaaaccttgccttcttcattttaagttaattttcccttgtgtgaccagttgttcacaacaggaacaaaataaaggaaatattaaaatacactgaaataagaaagagaggaaagaagaaatggaagggaggaattggagggaaatgaaacgcttccagaaggaaagcagatgtgcctatttcttgggggctgtatgaacacagtagacaaacagcagcatcctgggaatcaggtgagtgggctccacactctcactgatgagtctgattgtctgtgtggtctctggcaggtgtgctcattttcctgggttacaattacttcctctgtaaaatgaggggattgactaggggaatctgagttaccccccattgaacgcatgtcattcattcattgcgtctacctggcagctagtctgttttccaacttgagatatggggtgtggaccagagttcacactgggcatctcctaccagttgtgatttcattctcaacttaaccacagactccttgctaaccatgggcaaaatcattgtttttagttcattaatttcttatgtctggaaggttatctgcaactttcttgtgcacctcttttattttctttatttttaaggtatccatacagtcagttaggggagatgaacataggtggaaagataatagttgtcatcatttgtaaagttattctctctactcactccaatggaactaatttctagcttttagactcattgttgaaaacttctgatgaaaattattttatatagtgagaaaaggaccaatggaattttctaatctttgtttggaggcagaggcagatatgctggagtagtaaaatgcaaatccgggctgggcgcagtggctcccgcctgtaatcccagcactttgggagtctgaggcgggcggatcacgaggtcaggagatcgagaccatcctggctaacacggtgaaaccccgtctctactaaaaatacaaaaaattagccgggcctggtggtgggcacctgtagtcccagctactggggaggctgaggcaggagaatggcgtgaacccgggaggcggagcttgcagtgagcagagatcgcgccactgcactcctgctggggcggcagagagagactccgtctcaaaaaaaaaaagcaaatccgatgcccatagatactatcttgacagcagctccagattttaaaactcattcaatggcaggttttgaacgctggcttgcctttggagtctgaggtctaaatgacagttaagtctatgtctgtgttaaaggaagagacatctgcatgagtagacatttgtgcctggatgggattcaaatgaaacataggtaacagaacatcaattgcccataatgttctaatccaacatcctgtagtttctgagcaggcatttacagagttaatacttattagagactcaaggctcaacttttttcctgtatatcttgatattgcaaaccctggtagttttaattagtggccttttaatctctggagcaaagccaatggcctgttcccttggacaaatttcttaacaacctggcactgagtggctttgtctgcttgtgggagctctcgtacccaaggctgtcataaagagttacataggttatgtctgcatgaaggaaccagctgaagagatgggtgggtgttggaatcagttcttcttccatgtgccaagtgagtgtcctggtgtgagctacattcacctagaaaggtgtgcacacctagcgcacacaaaggcctatggtttcacctgatcctatcctactttcagtctccatttccttcctcgtttcatgccctaggacaacctggggtccaggagggctggctctgtgggtattgcaaccttcctactgcaggtcttggcactggactaaggaacaagagacctgcctcatgtctgagctcctctgtgtaatcttaggcaagttgcttatctcctcctatgactcagtttcttcatatgtataaagagaaaaatgtcactctatcaaggttagatggtgcagagggacagacagctggggttcaaacctctgtttgccacccattcactacctatgtatccttggccaagttatataagctttttatacctcgattttcttaatctgtacagtggagctaataatagcacctacctatatatcatgagtccttacaaaaaagcctacaaagtaggtgccattattatttccacttgacatatttaataaattgaagcctaggagaagacacgtaacttgcctaagatcacacagaggagctcagacatgaaccaggtttctgcctcttagtctagtgctaaaaccagtgcatgtgtgcatgtgtgcatgcttgtatagctacagatatagatatgtatgctggcatggataatacagatataggtatagatatagatatctatatgtacgtgtgtgtgtgctggtttatgtatatatatgtatatgtatctgtatgcacacacatatgtgtttgcatgtgtgtgtatagatacctttatatatacatatacacacacatgcacatgctgcttaaaacagtgcctggcctataatgctaagattattaagtacccaatgctcagtaagtactcaataaatgttacctattgctattatctgtagagaaagtttccacgtgctaacgttccctccctcctgtgctgggagtttgtggtttgaacagacgagagcccagcatgggcacccttggctttttgagcattatttgcattctgaactggggcctgacgacagcctgctctcagggtggggacaggagcagaaccatcagcgaactgactggtaaatatagcaaatcatccgatgggttggctgcatggggtgtgtctgtctgtatatgtttgtgtgtgttggagatagtagtggtatgtaagcttattttaactggaactcatattttctagcccctccaagaactaatacctctttttaatgtttcatgggaacactggacagagggtctttaaagtaaaaactcagtgactcattctctctcttcagtttttctgaactgctgagtagagagaggaatattttcaaggaaacacgaggagattaggatgaaccttctttgcccctcaccccacctcacctgctttgtacctatcagtggaaggtgagggctggtcttgggggcaggaagatggatgaagtgacatttgcaggatcccctgggggcaggtgtataggaggtgagtactcgaggggcatttcatcacgcattgctcttaggcatggctagcctggatgggtctcaattaggagtaaggagacctaggttcccatcctgcttggtctcaaatccctgcaaaggctgcaccttgagttgctaggcatttacttcccagacattccctgccccttactaccagtaaaagtggtaaatgcagggtgtggccagaatgcttttctaatccctagtgccactccaagtccccctacagagttaaagcctaaaatgacttcaaacccaatggaagacattgtgtgatggaaacagttctagttttccagttggctttctagccatgaatttgtgtcctgtgtcctttctccagcaggtcagggaaagtgcaaaaggcaggctttactctacattgactgcccagtgctaatgggtaggagcacgtcagccatgggactcgcagggaaacttgccacactttgaatataggagtcacctggctgtgtcttgtaaccagttggagacttcactcacagatgtcactctggggctactgaaaatagaagaaatcagataatacaaaatttctaactgtattcacattagtgtgttctttgttttcttatttatattcacagtcatgaaagaaaatgaggttaagtacctttacacatggtaaaaccaagaaactgaaaagtttagttacttccctgagctcacaaaacagtgacaagactctggatctcatttccctatctccctgtctctaacccaggataattctctggattgcattgcgtgtcagaatttctctgttcctacagtgtaaatttcagccttaagctccacctacaacttgccattttcgcccaaagcattcaagatgttcttttgcatccagaccctcctccaaatgaagaaagctgcagtgaaaatgccactgagttgaggggttgcaaaccaaacctccattcccataattcaattctcaggccccagccttctgctaaggctaacagatccactccaaaattttaagagtccacagtgatcaaaagcatctgtatattctgaaacatgcaaatcaaccctgtttttcacattcatctcaacatttggtggagggcacaagagtcagctggctgctgagtggacgcagcttagcagatgaatggaagggtcaaatccctctcaagatttgtagaactggatctgaaatatgaaatgccagcatacgtgatgagagggatagtctatcgagtgttttatcatccaaagatggaattaatggctatgccatatctgtgtcagaccccggcagtaaaactttatgggttcttccccgtgaaatattttgtttatgtcacgtgggtctcatcggatgtttttttctcttttcttcacttcccctccccacccttttccctgccctctttgtctcctgagacctattccctttggaaatgcattagttacctaggaaaccttaatgtcatttttttatgagtggagtttggtgcagcataaagttaatttatagggtggttaggaattcatgtcatgactggtgaaataggagactttattatgatttctacatccacctgtgtggtaggaatacataccttccctctatcattacgggtaatttcttgaaacgtaattatgaatatgtatgccatgtcacagaataagttgattcaccgttgttcaatgcaattcattatattgttcaatgtaagccctagaacataattagcaataacaacaaaccaataatataccaggcaatctgttaagagttgaaggatatggtggaatttccttttaaatgatgaggtggttctgggtgaaaggcagagaatgaataagacgagattttgaaatccttcaattctgtctttcatgcacattgaggtccacgttgggaagctatataaattctaaatatgtccactacttcattctgctgatttatttctgtatttgtccaaaggggaaaatatacatccataaaattacattaatgaaatgtgtagtggcatacaaataataatacacaggccattccagagccaagcttctttctaaagatagctcattcccccagtggtgtgacagtgtttcctgtgtaaggactagcagatcgggactggcattcacattgtgccaggcactgtgttgaatgttttaaattaattagttcctttggtcctcatattacttctatgagattggtgttgtcttcaccaattgcagatgggttctaagaagttaagaaacctgtacaaaagcacatggctactgagtggagaaggtagaggggaacctgcttttctcaggcaccaaaatctactctggcagtaaattctaggtcgtggtctgtcattatgtttttgtttttgttttttgttattctgagtttcctcagttattaaatgcagagtgggggacataggggctgatagaagtttatctctgatgtctgtattctgtgtagagagatcaatgctagtccttagagcaaagctgtgctttcttaaaatgacagaaatttgggggaagacctggtcttgttaaataaacataaacaagccactcagtttctgtggacaagtgcatgcgaattgaaagaaaagaagaatgtctcacaggtgactccaggtcatctgagaggaattgctatatggcttgacagcctgtagctcttggtgaataatgctgttgccagtatatagaaacgggtgggcagccaggaatctttcaagtgcggaggcacaaaggtagcatgaagccgcctttcctgacccttaagctcccagtccctgtgcaaacaccttttgcattcactttaattgtttgaaaaacgaagacttccagactccatcagctctagcagctgtctgggtggatgggggtggggatggagggggtagggcgagacctccccacagcgccctccagcagcagaagatgcaacttgcaaatacttcaggatcagtgagaagtgtggtgtttattttagtaacctcaaaagagagaaaaagaaaagcagtggaagaggacagacattcaaggctagctacacgatcatggggaaaaaaaacaagcttgtctttgacacggaaagggtccttggaggccattcggtccacttctctcatttcctgggtcaacatgtcacaatgaattaaccacatactgccactgcacaagaccccctccctcaccacacgctgagcccccaccaccagcattcagtccactgagctcaaacatagggagataagtgctgttttcacaagataaaggcaaaattcaatcccacgttgccgttttgtttctgttcagtgttccaaccacagagtggtgctattgcaaaagataagggtaaccagaaggcacgctctggaaatttgctttaggagagagttttaaagggggttttcaaaaacaagatctgattcctgctctcagaaatcacttccaggagtcagggccttactctcagatgcagcagggagaagaagaaagttcagcaacctaaaaatacagtcgacagatgggcagccaaagtcatggccacgaagtcaacttggagaggagcacctacctagtgaatcctaaaagatctcatcctggatgcttccttaaccaggcctatgtacagggcacaagctcgcagccagcttactttccagtcctgatctttgcttttgctatccataccaatggtatttctatagaaaagaaaaatctctatttagaaacacggatttacttagaagtcacaatattctagtttaaaaatggctctacatagtagagaatgatctttttattctgtcttcttaaaaatacacctttctaattctttttttcttcccaccttcttcattcagcaccttgccactcccttggaagccacaacagcgagctggggggtcagtccctagtcttagagggaagaaatctttaggtctgaagtctaaagaaaaacagtaaaggaaaaggcagttggcggtgctcaaggtagactgtctgaaagaggtcttctactcagaaaagggctaaggctctccctttgggaaaccaatccttctgagaaaaagtgcatctttcaccctctgctcctgtctgggtctctccctcttcctccctccttccctcagtccctcctcccctctctccacaaagacacagcacatatttggcaagattaaggtgtcacctctcatattacaaggcctgttgattgcaagcaaagacagacccaccagcttaggacaaaaccccttggagttggaaataagacaaactctgggatccccgaaagtcccggcaaaatgacgcggccagccagtgcaaggcatctgcagaacaaatccaagtcctaaacgcactgcttgctgccttttcttctccttcctttcttctgatttttcaagtttgtttgccccccttcccctcctccctccagactgccagggacctgggagctgcctgcagatcagcccgcacatgtatttaaccccttccctgctgcagcaggagccaaccacctctttccttgcaatcttcaggttcccagaggacctggagcttgagaaaagaactctgccagtggatctgaaactggggcctgaatccctcctttgaccagggcgagaagctggaggaggggggcaagtgcgggaagtgggggagggcagggaggcgggccagatgagagggagaaaagcagaacccgacagagcacgcccaatccaaaccttcatggtgctgtgtggctgggtggagggaacgactcggcagcctcttctggccctgaggaagacgtcgatattttggcacgaggggagccactgaaggactaccctacccttgcgagggaccgcaggaggtgacgcccctgggcctcggtgggcgcttctggcggttttcgatgtggcaacccccatcagccaggataatgatgaggcaggtacaatctatctagtacgcagcccccagactcccccctcccttcccacctccccatccaaccccccagctactctctgcggccggttggtcctgaactggtgggtgcagttccgatgtttaaccaaattctcaagcaatttcaaggtatttggattttttgaacctgggccctaaccgaaacgcggaacggcttgcttattagacacctcgaacgacagggcagggaggaaacgggatactcgctgcccttcccagtcgcgcgtgagtcaaaaggtcctggcaggagatgatgtgaggagcggctgaagtggcagggaggaagggatgaggggcttggagcggaggtccaccacgcaaggactcgggaagcgggcaagtgggcaaaactctgcttccgggctctcgatttctcgttgatcactaagtggtatttttcccccttctctcgatggcaaatgggcgaaatcaagatgacttaacttggtaaatttagagagaacggctcggagcaagtgaggtctaacgggcagctaaaattatctccaaataagagattttgaccccctccccctatcctctcctcgaatgtatccaccggtggggaagtgagcgtcattactttcggggcgccacgaacaggtttgtttgttgctcgcctttcctgcttctcgcgctgtccccgcgtgcagactggtgggtgctgggcgagtgattagctgcagggccccatcctagtttggaaggaaggggtttagaagttggaggatgggtgaaatgggaggctgcgatccatctccctctcccttccacactcaagctcccgcaaacacgcgcgcgcacacacagcccctccctagtccctcggaccacccgcccccacgcccctctaccttgacctcccttgaccgccgacacagcgtcctgggtgcgggtccccgggagcggggagttcgccggggagcgattgtccttgggcgtgttcgtgctgtggggtggggggaggagtggcgggtgggcttggtagggggtggggagagatctggagctggaagggtctaaggtttggaggaggagtttacgcctcagacctgatcctcctgaggaaaaaggcaggaaaaggccctgatgccttgtaaagaaaatcttgaaagaaaaaagatcaaaaagaaaaatttcaagaaaaagaaccactaagaaaggctgaagacactaacatgtaacctgttacgatacatttaacgtttcgttttttcctggatctctaaaagggaactcaagggtgggggttactgaagaatactacagatttggaagtttttgttgctgttgttgtttggtttggttttgtttttcaagaggggccaggagaaatgaccccttccccgccacgggtcccgaagtgagggcggggggggggctctggggcgcgggcgcgcgcggcgcggcgcgggccggcgggggagggcggcgcggcgcggaaggggttaaggcgctgagcgcggagccatctggccgggttggctggttataaccgcgcagattctgttcacgggactcagagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctcaggccgaagcgcaaccgcagccaccccgctacacacacacacacacacacacacacacacacacacacacacacacacacagacacggacacccttctccacctcctcccctcttgtccctcggctgcccaagaagcttccctcaatctgggaaagtgatcaggtttaagggacctggattggaaagggtgggggcagaagaggggaaatggggacgacgaaagagcaggaaagagattcaacagaatcaaccacccaccactcccaaccgacccgcctgctcctccgagaaagctcctagcgcatcctataacaaaagggggtggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagtccgaatggaggttgctcccgggagcgccgggctcagagctagagagctcgggagactgtgcgcctgtggacttgtttatgtgtgtgaagaggcgggggcgagggcctgctgagaggggaggggagcctggaaggggtgggtgtttctcctggagcctgatgtttgtaactcagctgattatggagtgcactgagcgacctgctttttaaataaagaggtgcccgctcctaccccgcaaaacagcgaacgaggagaacatggaagcgctctgtcctaaacgtcaggatgggagaaagttgtaacatagaggagacttttccagaggtcctgttttcacaacactcagaagttctccagcgtactcagcctgcctcccgcctgccctcaattcctttttgacatgtcacacaaagaaagctgaaaggtagaatgtggaggataaactccaaccccctctgccttgggcgcaaacacacagacttaggtatcgtgttaggaggtaagggggttggaaaataatgcaggctccggtagacagtgttgaagggagatagaaagtctggggtatttcccctagggagagtgtgtgggattttgtgttggtgaggactggagtgtagctggacttagagggtttggttgtgtgtgaatgggatatgcttatctatggagtgagattgtgaccattgagtgagtggtcagggagggatggggatgtttttccaaagtgtgtgtgtgtgtgtgtgtgtgtgtgtgtgtgtaggggaaggtggcaaaagagctggagtcctatccctctttggtgcctgggaggtgtgtgtttctggggagtctgtcggatgggcatctgtgtgcttagcgggagacaagagcttgcaggaacataggtgtagctaatgcgaaatctgtgcctatgaagggtgtcagagcaggaggagaggtgcagcctgttgaagacagatggcttgtgcatgcctgcacaaacacatggagtgggtgtggtgtaggagggcggctgtgtgtgtgagggaaaggtggatgcatgtggaaggttgggcgcctgaggattaccaaagggatgtgtgtggggggtgggggaagattatctgaggagcacggggtttgaacttcatgagggtgcactgggaaatttggctggaatggcactggggcatgtagggggtagaaaagtgtgagctcagatcctctttatggaaagacaaagcatttgcagggaaggacaccgggttggtgttggtgtttgcctcccccctccttcctccccagagagaagagaattggaggaggcttagaatgagggatgtacatttaaggggaaaagtccttgtgcattggcactgggtgggaacaggaagagatgtgtgcataagactgaagtaagtagaggaatgcactatctgtgcctggtgtcagggatgcatgttgtata

SEQ ID NO: 1717 - DNA, 16803 bp, Homo sapiens
cggtttgtttatgaaaaagtaattagcaggtagatacaagagttaagaatttatcccaggacttactgatagctttatcacaggaaaattaaaattaaaagttctgggggccaggcgcagtgacttacgcctataatcccagcactttgggaggccaaggcggccagatcacttgaggccaggagtttgagactagcctggctaacgtggcaaaacttcatctctacaaagaaaaaaaagaagaaaaatacaaaaaattagttgggcatggtggtgcacgcctgtaatcccagctactcgggagactaaggcacgagaatatctttaatccaggaggtggagggtgcagtgagccaagatcatgccactgcactccaatgtgggcaacacagtgagatgaatccgtctcaaaaaaaaaaaagttatatcaaagaaacatttcctcagcaaaatagatcctttcattatctttactacaaagcaaagaagataaaaaagcaagaaagatgtggagaaaaaagatttcctcagttgggaaccttaaaaggtcatctataataatattattgaaaaagagatagagttcatctatttaatcctgtttcttcagaaaagaccaaccttatgtcatcagaaataagaaagtagtaattacacttttaaagctgtcttttaatcccacctgtgattaaaattcttttctagctcctactaaaaccttgccttcttcattttaagttaattttcccttgtgtgaccagttgttcacaacaggaacaaaataaaggaaatattaaaatacactgaaataagaaagagaggaaagaagaaatggaagggaggaattggagggaaatgaaacgcttccagaaggaaagcagatgtgcctatttcttgggggctgtatgaacacagtagacaaacagcagcatcctgggaatcaggtgagtgggctccacactctcactgatgagtctgattgtctgtgtggtctctggcaggtgtgctcattttcctgggttacaattacttcctctgtaaaatgaggggattgactaggggaatctgagttaccccccattgaacgcatgtcattcattcattgcgtctacctggcagctagtctgttttccaacttgagatatggggtgtggaccagagttcacactgggcatctcctaccagttgtgatttcattctcaacttaaccacagactccttgctaaccatgggcaaaatcattgtttttagttcattaatttcttatgtctggaaggttatctgcaactttcttgtgcacctcttttattttctttatttttaaggtatccatacagtcagttaggggagatgaacataggtggaaagataatagttgtcatcatttgtaaagttattctctctactcactccaatggaactaatttctagcttttagactcattgttgaaaacttctgatgaaaattattttatatagtgagaaaaggaccaatggaattttctaatctttgtttggaggcagaggcagatatgctggagtagtaaaatgcaaatccgggctgggcgcagtggctcccgcctgtaatcccagcactttgggagtctgaggcgggcggatcacgaggtcaggagatcgagaccatcctggctaacacggtgaaaccccgtctctactaaaaatacaaaaaattagccgggcctggtggtgggcacctgtagtcccagctactggggaggctgaggcaggagaatggcgtgaacccgggaggcggagcttgcagtgagcagagatcgcgccactgcactcctgctggggcggcagagagagactccgtctcaaaaaaaaaaagcaaatccgatgcccatagatactatcttgacagcagctccagattttaaaactcattcaatggcaggttttgaacgctggcttgcctttggagtctgaggtctaaatgacagttaagtctatgtctgtgttaaaggaagagacatctgcatgagtagacatttgtgcctggatgggattcaaatgaaacataggtaacagaacatcaattgcccataatgttctaatccaacatcctgtagtttctgagcaggcatttacagagttaatacttattagagactcaaggctcaacttttttcctgtatatcttgatattgcaaaccctggtagttttaattagtggccttttaatctctggagcaaagccaatggcctgttcccttggacaaatttcttaacaacctggcactgagtggctttgtctgcttgtgggagctctcgtacccaaggctgtcataaagagttacataggttatgtctgcatgaaggaaccagctgaagagatgggtgggtgttggaatcagttcttcttccatgtgccaagtgagtgtcctggtgtgagctacattcacctagaaaggtgtgcacacctagcgcacacaaaggcctatggtttcacctgatcctatcctactttcagtctccatttccttcctcgtttcatgccctaggacaacctggggtccaggagggctggctctgtgggtattgcaaccttcctactgcaggtcttggcactggactaaggaacaagagacctgcctcatgtctgagctcctctgtgtaatcttaggcaagttgcttatctcctcctatgactcagtttcttcatatgtataaagagaaaaatgtcactctatcaaggttagatggtgcagagggacagacagctggggttcaaacctctgtttgccacccattcactacctatgtatccttggccaagttatataagctttttatacctcgattttcttaatctgtacagtggagctaataatagcacctacctatatatcatgagtccttacaaaaaagcctacaaagtaggtgccattattatttccacttgacatatttaataaattgaagcctaggagaagacacgtaacttgcctaagatcacacagaggagctcagacatgaaccaggtttctgcctcttagtctagtgctaaaaccagtgcatgtgtgcatgtgtgcatgcttgtatagctacagatatagatatgtatgctggcatggataatacagatataggtatagatatagatatctatatgtacgtgtgtgtgtgctggtttatgtatatatatgtatatgtatctgtatgcacacacatatgtgtttgcatgtgtgtgtatagatacctttatatatacatatacacacacatgcacatgctgcttaaaacagtgcctggcctataatgctaagattattaagtacccaatgctcagtaagtactcaataaatgttacctattgctattatctgtagagaaagtttccacgtgctaacgttccctccctcctgtgctgggagtttgtggtttgaacagacgagagcccagcatgggcacccttggctttttgagcattatttgcattctgaactggggcctgacgacagcctgctctcagggtggggacaggagcagaaccatcagcgaactgactggtaaatatagcaaatcatccgatgggttggctgcatggggtgtgtctgtctgtatatgtttgtgtgtgttggagatagtagtggtatgtaagcttattttaactggaactcatattttctagcccctccaagaactaatacctctttttaatgtttcatgggaacactggacagagggtctttaaagtaaaaactcagtgactcattctctctcttcagtttttctgaactgctgagtagagagaggaatattttcaaggaaacacgaggagattaggatgaaccttctttgcccctcaccccacctcacctgctttgtacctatcagtggaaggtgagggctggtcttgggggcaggaagatggatgaagtgacatttgcaggatcccctgggggcaggtgtataggaggtgagtactcgaggggcatttcatcacgcattgctcttaggcatggctagcctggatgggtctcaattaggagtaaggagacctaggttcccatcctgcttggtctcaaatccctgcaaaggctgcaccttgagttgctaggcatttacttcccagacattccctgccccttactaccagtaaaagtggtaaatgcagggtgtggccagaatgcttttctaatccctagtgccactccaagtccccctacagagttaaagcctaaaatgacttcaaacccaatggaagacattgtgtgatggaaacagttctagttttccagttggctttctagccatgaatttgtgtcctgtgtcctttctccagcaggtcagggaaagtgcaaaaggcaggctttactctacattgactgcccagtgctaatgggtaggagcacgtcagccatgggactcgcagggaaacttgccacactttgaatataggagtcacctggctgtgtcttgtaaccagttggagacttcactcacagatgtcactctggggctactgaaaatagaagaaatcagataatacaaaatttctaactgtattcacattagtgtgttctttgttttcttatttatattcacagtcatgaaagaaaatgaggttaagtacctttacacatggtaaaaccaagaaactgaaaagtttagttacttccctgagctcacaaaacagtgacaagactctggatctcatttccctatctccctgtctctaacccaggataattctctggattgcattgcgtgtcagaatttctctgttcctacagtgtaaatttcagccttaagctccacctacaacttgccattttcgcccaaagcattcaagatgttcttttgcatccagaccctcctccaaatgaagaaagctgcagtgaaaatgccactgagttgaggggttgcaaaccaaacctccattcccataattcaattctcaggccccagccttctgctaaggctaacagatccactccaaaattttaagagtccacagtgatcaaaagcatctgtatattctgaaacatgcaaatcaaccctgtttttcacattcatctcaacatttggtggagggcacaagagtcagctggctgctgagtggacgcagcttagcagatgaatggaagggtcaaatccctctcaagatttgtagaactggatctgaaatatgaaatgccagcatacgtgatgagagggatagtctatcgagtgttttatcatccaaagatggaattaatggctatgccatatctgtgtcagaccccggcagtaaaactttatgggttcttccccgtgaaatattttgtttatgtcacgtgggtctcatcggatgtttttttctcttttcttcacttcccctccccacccttttccctgccctctttgtctcctgagacctattccctttggaaatgcattagttacctaggaaaccttaatgtcatttttttatgagtggagtttggtgcagcataaagttaatttatagggtggttaggaattcatgtcatgactggtgaaataggagactttattatgatttctacatccacctgtgtggtaggaatacataccttccctctatcattacgggtaatttcttgaaacgtaattatgaatatgtatgccatgtcacagaataagttgattcaccgttgttcaatgcaattcattatattgttcaatgtaagccctagaacataattagcaataacaacaaaccaataatataccaggcaatctgttaagagttgaaggatatggtggaatttccttttaaatgatgaggtggttctgggtgaaaggcagagaatgaataagacgagattttgaaatccttcaattctgtctttcatgcacattgaggtccacgttgggaagctatataaattctaaatatgtccactacttcattctgctgatttatttctgtatttgtccaaaggggaaaatatacatccataaaattacattaatgaaatgtgtagtggcatacaaataataatacacaggccattccagagccaagcttctttctaaagatagctcattcccccagtggtgtgacagtgtttcctgtgtaaggactagcagatcgggactggcattcacattgtgccaggcactgtgttgaatgttttaaattaattagttcctttggtcctcatattacttctatgagattggtgttgtcttcaccaattgcagatgggttctaagaagttaagaaacctgtacaaaagcacatggctactgagtggagaaggtagaggggaacctgcttttctcaggcaccaaaatctactctggcagtaaattctaggtcgtggtctgtcattatgtttttgtttttgttttttgttattctgagtttcctcagttattaaatgcagagtgggggacataggggctgatagaagtttatctctgatgtctgtattctgtgtagagagatcaatgctagtccttagagcaaagctgtgctttcttaaaatgacagaaatttgggggaagacctggtcttgttaaataaacataaacaagccactcagtttctgtggacaagtgcatgcgaattgaaagaaaagaagaatgtctcacaggtgactccaggtcatctgagaggaattgctatatggcttgacagcctgtagctcttggtgaataatgctgttgccagtatatagaaacgggtgggcagccaggaatctttcaagtgcggaggcacaaaggtagcatgaagccgcctttcctgacccttaagctcccagtccctgtgcaaacaccttttgcattcactttaattgtttgaaaaacgaagacttccagactccatcagctctagcagctgtctgggtggatgggggtggggatggagggggtagggcgagacctccccacagcgccctccagcagcagaagatgcaacttgcaaatacttcaggatcagtgagaagtgtggtgtttattttagtaacctcaaaagagagaaaaagaaaagcagtggaagaggacagacattcaaggctagctacacgatcatggggaaaaaaaacaagcttgtctttgacacggaaagggtccttggaggccattcggtccacttctctcatttcctgggtcaacatgtcacaatgaattaaccacatactgccactgcacaagaccccctccctcaccacacgctgagcccccaccaccagcattcagtccactgagctcaaacatagggagataagtgctgttttcacaagataaaggcaaaattcaatcccacgttgccgttttgtttctgttcagtgttccaaccacagagtggtgctattgcaaaagataagggtaaccagaaggcacgctctggaaatttgctttaggagagagttttaaagggggttttcaaaaacaagatctgattcctgctctcagaaatcacttccaggagtcagggccttactctcagatgcagcagggagaagaagaaagttcagcaacctaaaaatacagtcgacagatgggcagccaaagtcatggccacgaagtcaacttggagaggagcacctacctagtgaatcctaaaagatctcatcctggatgcttccttaaccaggcctatgtacagggcacaagctcgcagccagcttactttccagtcctgatctttgcttttgctatccataccaatggtatttctatagaaaagaaaaatctctatttagaaacacggatttacttagaagtcacaatattctagtttaaaaatggctctacatagtagagaatgatctttttattctgtcttcttaaaaatacacctttctaattctttttttcttcccaccttcttcattcagcaccttgccactcccttggaagccacaacagcgagctggggggtcagtccctagtcttagagggaagaaatctttaggtctgaagtctaaagaaaaacagtaaaggaaaaggcagttggcggtgctcaaggtagactgtctgaaagaggtcttctactcagaaaagggctaaggctctccctttgggaaaccaatccttctgagaaaaagtgcatctttcaccctctgctcctgtctgggtctctccctcttcctccctccttccctcagtccctcctcccctctctccacaaagacacagcacatatttggcaagattaaggtgtcacctctcatattacaaggcctgttgattgcaagcaaagacagacccaccagcttaggacaaaaccccttggagttggaaataagacaaactctgggatccccgaaagtcccggcaaaatgacgcggccagccagtgcaaggcatctgcagaacaaatccaagtcctaaacgcactgcttgctgccttttcttctccttcctttcttctgatttttcaagtttgtttgccccccttcccctcctccctccagactgccagggacctgggagctgcctgcagatcagcccgcacatgtatttaaccccttccctgctgcagcaggagccaaccacctctttccttgcaatcttcaggttcccagaggacctggagcttgagaaaagaactctgccagtggatctgaaactggggcctgaatccctcctttgaccagggcgagaagctggaggaggggggcaagtgcgggaagtgggggagggcagggaggcgggccagatgagagggagaaaagcagaacccgacagagcacgcccaatccaaaccttcatggtgctgtgtggctgggtggagggaacgactcggcagcctcttctggccctgaggaagacgtcgatattttggcacgaggggagccactgaaggactaccctacccttgcgagggaccgcaggaggtgacgcccctgggcctcggtgggcgcttctggcggttttcgatgtggcaacccccatcagccaggataatgatgaggcaggtacaatctatctagtacgcagcccccagactcccccctcccttcccacctccccatccaaccccccagctactctctgcggccggttggtcctgaactggtgggtgcagttccgatgtttaaccaaattctcaagcaatttcaaggtatttggattttttgaacctgggccctaaccgaaacgcggaacggcttgcttattagacacctcgaacgacagggcagggaggaaacgggatactcgctgcccttcccagtcgcgcgtgagtcaaaaggtcctggcaggagatgatgtgaggagcggctgaagtggcagggaggaagggatgaggggcttggagcggaggtccaccacgcaaggactcgggaagcgggcaagtgggcaaaactctgcttccgggctctcgatttctcgttgatcactaagtggtatttttcccccttctctcgatggcaaatgggcgaaatcaagatgacttaacttggtaaatttagagagaacggctcggagcaagtgaggtctaacgggcagctaaaattatctccaaataagagattttgaccccctccccctatcctctcctcgaatgtatccaccggtggggaagtgagcgtcattactttcggggcgccacgaacaggtttgtttgttgctcgcctttcctgcttctcgcgctgtccccgcgtgcagactggtgggtgctgggcgagtgattagctgcagggccccatcctagtttggaaggaaggggtttagaagttggaggatgggtgaaatgggaggctgcgatccatctccctctcccttccacactcaagctcccgcaaacacgcgcgcgcacacacagcccctccctagtccctcggaccacccgcccccacgcccctctaccttgacctcccttgaccgccgacacagcgtcctgggtgcgggtccccgggagcggggagttcgccggggagcgattgtccttgggcgtgttcgtgctgtggggtggggggaggagtggcgggtgggcttggtagggggtggggagagatctggagctggaagggtctaaggtttggaggaggagtttacgcctcagacctgatcctcctgaggaaaaaggcaggaaaaggccctgatgccttgtaaagaaaatcttgaaagaaaaaagatcaaaaagaaaaatttcaagaaaaagaaccactaagaaaggctgaagacactaacatgtaacctgttacgatacatttaacgtttcgttttttcctggatctctaaaagggaactcaagggtgggggttactgaagaatactacagatttggaagtttttgttgctgttgttgtttggtttggttttgtttttcaagaggggccaggagaaatgaccccttccccgccacgggtcccgaagtgagggcggggggggggctctggggcgcgggcgcgcgcggcgcggcgcgggccggcgggggagggcggcgcggcgcggaaggggttaaggcgctgagcgcggagccatctggccgggttggctggttataaccgcgcagattctgttcacgggactcagagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctcaggccgaagcgcaaccgcagccaccccgctacacacacacacacacacacacacacacacacacacacacacacacacacagacacggacacccttctccacctcctcccctcttgtccctcggctgcccaagaagcttccctcaatctgggaaagtgatcaggtttaagggacctggattggaaagggtgggggcagaagaggggaaatggggacgacgaaagagcaggaaagagattcaacagaatcaaccacccaccactcccaaccgacccgcctgctcctccgagaaagctcctagcgcatcctataacaaaagggggtggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagtccgaatggaggttgctcccgggagcgccgggctcagagctagagagctcgggagactgtgcgcctgtggacttgtttatgtgtgtgaagaggcgggggcgagggcctgctgagaggggaggggagcctggaaggggtgggtgtttctcctggagcctgatgtttgtaactcagctgattatggagtgcactgagcgacctgctttttaaataaagaggtgcccgctcctaccccgcaaaacagcgaacgaggagaacatggaagcgctctgtcctaaacgtcaggatgggagaaagttgtaacatagaggagacttttccagaggtcctgttttcacaacactcagaagttctccagcgtactcagcctgcctcccgcctgccctcaattcctttttgacatgtcacacaaagaaagctgaaaggtagaatgtggaggataaactccaaccccctctgccttgggcgcaaacacacagacttaggtatcgtgttaggaggtaagggggttggaaaataatgcaggctccggtagacagtgttgaagggagatagaaagtctggggtatttcccctagggagagtgtgtgggattttgtgttggtgaggactggagtgtagctggacttagagggtttggttgtgtgtgaatgggatatgcttatctatggagtgagattgtgaccattgagtgagtggtcagggagggatggggatgtttttccaaagtgtgtgtgtgtgtgtgtgtgtgtgtgtgtgtgtaggggaaggtggcaaaagagctggagtcctatccctctttggtgcctgggaggtgtgtgtttctggggagtctgtcggatgggcatctgtgtgcttagcgggagacaagagcttgcaggaacataggtgtagctaatgcgaaatctgtgcctatgaagggtgtcagagcaggaggagaggtgcagcctgttgaagacagatggcttgtgcatgcctgcacaaacacatggagtgggtgtggtgtaggagggcggctgtgtgtgtgagggaaaggtggatgcatgtggaaggttgggcgcctgaggattaccaaagggatgtgtgtggggggtgggggaagattatctgaggagcacggggtttgaacttcatgagggtgcactgggaaatttggctggaatggcactggggcatgtagggggtagaaaagtgtgagctcagatcctctttatggaaagacaaagcatttgcagggaaggacaccgggttggtgttggtgtttgcctcccccctccttcctccccagagagaagagaattggaggaggcttagaatgagggatgtacatttaaggggaaaagtccttgtgcattggcactgggtgggaacaggaagagatgtgtgcataagactgaagtaagtagaggaatgcactatctgtgcctggtgtcagggatgcatgttgtataatgttttgtaatgggtttcttatgtaataggagaattcactatcaccagttcatattgataatcaattaaagctaatggagtgcctactggatgctcagcccattgctgggtactggggcatggcacactgccctggaaaaattccttctccaggctcagtaaaactgatgcaattttgccagaaatagacagagctcgacgcttgttgaggtttcttcaaggtctataattcagtttctagagatgtttatggatcttgggggccaaagggaagctgacttgaaatatatctctggttttgtaaaaagtggggcataaagagagggatgatgtagacttttgtgtattgggaagggagctggacggtgttgttgtttcttgtgtggggtgtgggctgggaattggagggtgctgcacttcaggtcagaatgcaggtccagatccctctaaggattgagtttctaagagtacacagagcctccttcatagctggaatgagacctgttatgtggagctggagaatggtgaagtcatgatcaaggaagagatggactgggagtgtttgttcatctttgatgttttctgggctacgagtgtaaagctaacctgagtgtgtgttgggggggtgggtatgcatgcaggtgcgtgcacatgcactttggcctggagtaacgtaactgggagaaaactagcgaggtggataggaggggtggatattctggctcttgtgaagggggtgccagtatgtgtttttgcaggaattctgtgtgtctggggaaggataaaaattgtcttggatactcagatgtgcatctttagcgaaaaaaggtgtacacaaaagaagggccgtagactttggggaatgagacaaaggtgtcgttgatcgggtccataccctgagatggctggtgaggcaactgggtaggaacagagtgaaggctgtgcttttgtgatgcacacatctgcctgtctggagcagacgatggggatccccatttgattaggttctgaccaccgttgggcatatgtttgggaggactttatttgactcatgacatttttgaattcatgaagttacagctgtgccattttaagggtctaccttatttttgagagggaaactcatctgtgtaagagatagtttatatagggcttgactattggtcagaagatccggggcagatatttctgagagcagggtggtgaagtgcaagactggattgggaatgtcttagttctagtccagttctaccacttgggaaaagtgtgactttggggacatttttaatctctataactcttctgtttctctttttgtaaaggggcaatataatgactcaaggagaaggaaagttcactcctcttttcccccatcaaaacttgatgtgtttagttgtatacagccatacaaagatgaaatgtaattaaatacaggtgctagcacgtatgtaggtcattgtgaaaataggatctggacccctttctctttacaatgcaacttaatcagtaatcatgatgcccacagcatctctactgctcactcattgtgtaaataaaactttttataactgcctcagtttactcatccagaagctggaggcagccaaacctagattatagatgatggaaatctttaagatctttgagctattcagaggaaaggtagtctaagaatcaatgttattaatgatcagagacagacatttctttattttttaacatcagctatgcagaccacagcaccaaaagaaatgtgacgtggagaacagcaaaaataataattgcccttgacataggcaccatttgaataaaagaagagcaaagtctagcctgcctggtaagaggaaagcctgggctttgggtctttgaaattctttgtgcccagtgcagcaagttgggtacagccactttccccagagatgaagatggagtcgtagaggggcatggaaacacactgaaacctccgattcctcccagaagtcagtacatgctgtcaactcctggctcagagtcaggctcccatccttgagttcagtggccataaatagtcaggagctaagctatttccaagaggcactaaactaattctgttgcttttcttggcgagattgggccaattaagttgattggaagaggtcactgctgatgggtctcacattccccaggcgggacaggccagcagagtttaattacataacatttcccatgtcttcacttccactcccagatgtatcagatgttcaggcctctcctctttccctacattcaggatgcctgacggagcaggcggcttctgctacaagcttctccagaccttttcctgagcagttacagcactcccaccccaactggagggaatgcaagtctgtgcattgcctggaagtgagagaggggatgcaggctgacacagaagatctttagagcccaccaccctgcctcaagcctcacccgcggctgttttactctttaacgaggcaggcagtttctggcgttggggatgttgaactaatgaccgttgctagggttttagatttagttttatttaaaaatgagtttgttggaaaaggaccaaatcttctactggagacaagcctaagccccgtgtggtgctgctgataaggtctgtggatgtactttgtgcatggacaggcatgtgtggagtaagaggagagcacaggatgtgcgtgcgtgcgtgctgggggacacgtgagcgtaggagatgccctgggtagatggggcatttgtagagcttatgttatgggtggcaggtatctggatgcttggctcagattggattgtcattggattgcttcttacaggtgggacagcctgagaaaaaagttggggacaccttccttcagatcatttttatatgggcatgttgaaccttgaagtatgaggccagtgtagatattacctcattcttgcctggatggatttctaacaagattgaggctggacaaaaaaaaaaaaagtctttcagaggactcattttagaacctgtgagaacacatgtagatggccccagagcgttaaagtattttttgttgttgttaatagttttccataactcagtcttttgttttacctaaaaatactgagaggctagaggttgcacacacccccacatggtcagaatgcatttgctgttcatgtccccatctgtgccatggtccttctcaaataggattaattgggaactacggagagcttgccgcagctttggttgtcctcacagg
